(12) United States Patent
Wells et al.

(10) Patent No.: US 8,026,065 B2
(45) Date of Patent: Sep. 27, 2011

(54) ASSESSMENT OF OOCYTE COMPETENCE

(75) Inventors: Dagan Wells, Oxford (GB); Pasquale Patrizio, Guilford, CT (US)

(73) Assignee: Yale University, New Haven, CT (US)

( * ) Notice: Subject to any disclaimer, the term of this patent is extended or adjusted under 35 U.S.C. 154(b) by 0 days.

(21) Appl. No.: 12/312,275

(22) PCT Filed: Nov. 2, 2007

(86) PCT No.: PCT/US2007/023216
§ 371 (c)(1), (2), (4) Date: Jan. 4, 2010

(87) PCT Pub. No.: WO2008/066655
PCT Pub. Date: Jun. 5, 2008

(65) Prior Publication Data
US 2010/0120624 A1     May 13, 2010

Related U.S. Application Data

(60) Provisional application No. 60/856,157, filed on Nov. 2, 2006.

(51) Int. Cl.
*C12Q 1/68* (2006.01)
(52) U.S. Cl. ........................................................ 435/6.1
(58) Field of Classification Search .................. None
See application file for complete search history.

(56) References Cited

U.S. PATENT DOCUMENTS

| 6,294,336 B1 | 9/2001 | Boyce-Jacino et al. | |
| 2001/0053519 A1 * | 12/2001 | Fodor et al. | 435/6 |

OTHER PUBLICATIONS

Dode et al., 2006, Mol Reprod Dev 73:288-297.
Patrizio et al., 2007, Repro BioMedicine Online 15:346-353.
Russell et al., 2006, Mol Repro Devel 73:1255-1270.
Wells et al., 1999, Nuc Acids Res 27:1214-1218.
Wells et al., 2002, Fertility and Sterility 78:543-549.
Wells et al., 2005, Fertility and Sterility 84:343-355.
Gregory. "Ovarian markers of implantation potential in assisted reproduction." 1998, Human Reproduction 13(suppl 4):117-132.
Gagne et al., "Quantitative Evaluation of the mRNA Levels of Bovine Granulosa Cell Gene Markers Assciated with Oocyte Developmental Competence." 2001, Biol Reprod 61(suppl 1):1.
McKenzie et al., "Human cumulus granulosa cell gene expression: a predictor of fertilization and embryo selection in women undergoing IVF." 2004, Human Reproduction 19(12):2869-74.
Wells et al., "Association of abnormal morphology and altered gene expression in human preimplantation embryos." 2005, Fertil Steril 84(2):343-355.
Applied Biosystems: "Applied Biosystems Human Genome Survey Microarray V2.0.".
Robert et al., "Differential Display and Suppressive Subtractive Hybridization Used to Identify Granulosa Cell Messenger RNA Associated with Bovine Oocyte Developmental Competence." 2001 Biol Reprod 64(6):1812-1820.

* cited by examiner

*Primary Examiner* — Christopher M. Babic
(74) *Attorney, Agent, or Firm* — Riverside Law, LLP

(57) ABSTRACT

Methods are provided for evaluating an oocyte for fertilization and implantation. For example, methods are provided for determining whether an oocyte expresses, or does not express, one or more of a group of markers identified as differently expressed between chromosomally normal and chromosomally abnormal oocytes. Also provided, for example, are methods for determining whether a cumulus cell expresses, or does not express, one or more of a group of markers identified as differently expressed between cumulus cells associated with chromosomally normal oocytes and cumulus cells associated with chromosomally abnormal oocytes. Methods are provided for the detection of marker expression of differentially expressed genes at the RNA level, as well as at the protein level.

48 Claims, 8 Drawing Sheets

| Exemplified by SEQ ID NOS: | Entrez GeneID | Ensembl GeneID | Gene Symbol | Gene Name | abnormal/ normal | p-value |
|---|---|---|---|---|---|---|
| 1, 93 | 2533 | ENSG00000082074 | FYB | FYN binding protein (FYB-120/130) | 0.1962 | 0.00046 |
| 2, 94 | 440073 | ENSG00000120645 | IQSEC3 | IQ motif and Sec7 domain 3 | 1.6546 | 0.00063 |
| 3, 95 | 29097 | ENSG00000143771 | CNIH4 | cornichon homolog 4 | 0.1966 | 0.00088 |
| 4, 96 | 340419 | ENSG00000147655 | RSPO2 | R-spondin 2 homolog | 1.7716 | 0.00099 |
| 5, 97 | 9851 | ENSG00000198920 | KIAA0753 | KIAA0753 | 0.0784 | 0.00114 |
| 6, 98 | 222484 | ENSG00000139517 | LNX2 | ligand of numb-protein X 2 | 0.3123 | 0.00161 |
| 7 | 284475 | -- | LOC284475 | hypothetical protein | 0.4473 | 0.00243 |
| 8, 99 | 126789 | ENSG00000169972 | PUSL1 | pseudouridylate synthase-like 1 | 1.7901 | 0.00274 |
| 9, 100 | 113179 | ENSG00000213638 | ADAT3 | adenosine deaminase, tRNA-specific 3 | 0.2204 | 0.00279 |
| 10, 101 | 3621 | ENSG00000153487 | ING1 | inhibitor of growth family, member 1 | 12.2589 | 0.00388 |
| 11, 102 | 55611 | ENSG00000167770 | OTUB1 | OTU domain, ubiquitin aldehyde binding 1 | 0.4151 | 0.00391 |
| 12, 103 | 5081 | ENSG00000009709 | PAX7 | paired box gene 7 | 2.7515 | 0.00447 |
| 13, 104 | 5919 | ENSG00000106538 | RARRES2 | retinoic acid receptor responder (tazarotene | 2.5706 | 0.00476 |
| 14, 105 | 25963 | ENSG00000103978 | TMEM87A | transmembrane protein 87A | 2.8555 | 0.00494 |
| 15, 106 | 501 | ENSG00000164904; | ALDH7A1 | aldehyde dehydrogenase 7 family, member A1 | 0.4209 | 0.00522 |
| 16, 107 | 8394 | ENSG00000143398 | PIP5K1A | phosphatidylinositol-4-phosphate 5-kinase, | 0.4273 | 0.03590 |
| 17, 108 | 9254 | ENSG00000007402 | CACNA2D2 | calcium channel, voltage-dependent, alpha | 4.4399 | 0.00533 |
| 18, 109 | 54033 | ENSG00000185272 | RBM11 | RNA binding motif protein 11 | 0.3571 | 0.00534 |
| 19, 110 | 84643 | ENSG00000141200 | KIF2B | kinesin family member 2B | 3.6393 | 0.00570 |
| 20, 111 | 84074 | ENSG00000129646 | QRICH2 | glutamine rich 2 | 2.6744 | 0.00579 |
| 21, 112 | 4759 | ENSG00000115488 | NEU2 | sialidase 2 (cytosolic sialidase) NEU2 | 2.6492 | 0.00637 |
| 22, 113 | 25923 | ENSG00000184743 | ALTA3 | DKFZP56410863 protein | 0.0703 | 0.00678 |
| 23, 114 | 83657 | ENSG00000168589 | DYNLRB2 | dynein, cytoplasmic, light polypeptide 2B | 2.6787 | 0.00791 |
| 24, 115 | 144501 | ENSG00000167767 | KRT80 | keratin 80 | 0.7072 | 0.00815 |
| 25, 116 | 5162 | ENSG00000168291 | PDHB | pyruvate dehydrogenase (lipoamide) beta | 0.2264 | 0.00910 |

FIGURE 1A

| Exemplified by SEQ ID NOS: | Entrez GeneID | Ensembl GeneID | Gene Symbol | Gene Name | abnormal/ normal | p-value |
|---|---|---|---|---|---|---|
| 26, 117 | 10533 | ENSG00000197548 | ATG7 | ATG7 autophagy related 7 homolog | 0.5964 | 0.00935 |
| 27, 118 | 5558 | ENSG00000146143 | PRIM2 | primase, polypeptide 2A, 58kDa | 2.4069 | 0.00970 |
| 28, 119 | 10097 | ENSG00000138071 | ACTR2 | ARP2 actin-related protein 2 homolog | 3.4179 | 0.01011 |
| 29, 120 | 91433 | ENSG00000166965 | RCCD1 | RCC1 domain containing 1 | | |
| 30, 121 | 339287 | ENSG00000188895 | MSL-1 | male-specific lethal-1 homolog | 0.2941 | 0.01145 |
| 31, 122 | 51514 | ENSG00000143476 | DTL | denticleless homolog | 5.3455 | 0.01253 |
| 32, 123 | 91768 | ENSG00000134508 | CABLES1 | Cdk5 and Abl enzyme substrate 1 | 1.8754 | 0.01308 |
| 33, 124 | 345611 | -- | IRGM | immunity-related GTPase family, M | 3.1934 | 0.01334 |
| 34, 125 | 23788 | ENSG00000109919 | MTCH2 | mitochondrial carrier homolog 2 | 0.3084 | 0.01354 |
| 35, 126 | 5125 | ENSG00000099139 | PCSK5 | proprotein convertase subtilisin/kexin type 5 | 5.0740 | 0.01542 |
| 36, 127 | 64064 | ENSG00000198754 | OXCT2 | 3-oxoacid CoA transferase 2 | 0.5209 | 0.01546 |
| 37, 128 | 1843 | ENSG00000120129 | DUSP1 | dual specificity phosphatase 1 | 0.0849 | 0.01594 |
| 38, 129 | 10970 | ENSG00000136026 | CKAP4 | cytoskeleton-associated protein 4 | 0.2647 | 0.01598 |
| 39, 130 | 128240 | ENSG00000163382 | APOA1BP | apolipoprotein A-I binding protein | 3.6208 | 0.01609 |
| 40, 131 | 84109 | ENSG00000186867 | GPR103 | G protein-coupled receptor 103 | 0.3496 | 0.01685 |
| 41, 132 | 90338 | ENSG00000170949 | ZNF160 | zinc finger protein 160 | 0.2457 | 0.01733 |
| 42, 133 | 9708 | ENSG00000214574 | PCDHGA8 | protocadherin gamma subfamily A, 8 | 1.8571 | 0.01774 |
| 43, 134 | 5201 | ENSG00000113068 | PFDN1 | prefoldin 1 | 4.5350 | 0.01812 |
| 44, 135 | 23761 | ENSG00000100141 | PISD | phosphatidylserine decarboxylase | 0.5412 | 0.01912 |
| 45, 136 | 7277 | ENSG00000127824 | TUB4A | tubulin, alpha 1 (testis specific) | 1.5449 | 0.01937 |
| 46, 137 | 23705 | ENSG00000182985 | CADM1 | immunoglobulin superfamily, member 4 | 2.3015 | 0.01955 |
| 47, 138 | 9373 | ENSG00000137055 | PLAA | phospholipase A2-activating protein | 0.4540 | 0.02028 |
| 48, 139 | 27242 | ENSG00000146072 | TNFRSF21 | tumor necrosis factor receptor superfamily, | 0.4338 | 0.02048 |
| 49 | 439991 | -- | LOC439991 | similar to D-PCa-2 protein | 1.3575 | 0.02243 |
| 50, 140 | 219988 | ENSG00000166889 | PATL1 | topoisomerase II-associated protein | 0.3673 | 0.02299 |

FIGURE 1B

| Exemplified by SEQ ID NOS: | Entrez GeneID | Ensembl GeneID | Gene Symbol | Gene Name | abnormal/ normal | p-value |
|---|---|---|---|---|---|---|
| 51, 141 | 5797 | ENSG00000173482 | PTPRM | protein tyrosine phosphatase, receptor type, M | 0.2815 | 0.02410 |
| 52, 142 | 10497 | ENSG00000198722 | UNC13B | unc-13 homolog B | 0.3288 | 0.02429 |
| 53, 143 | 10461 | ENSG00000153208 | MERTK | c-mer proto-oncogene tyrosine kinase | 0.3436 | 0.02470 |
| 54, 144 | 1997 | ENSG00000120690 | ELF1 | E74-like factor 1 (ets domain transcription | 0.2396 | 0.02496 |
| 55, 145 | 56604 | ENSG00000127589 | TUBB4Q | tubulin, beta polypeptide 4, member Q | 1.8208 | 0.02637 |
| 56, 146 | 5223 | ENSG00000171314 | PGAM1 | phosphoglycerate mutase 1 (brain) | 0.1760 | 0.03014 |
| 57, 147 | 5395 | ENSG00000122512 | PMS2 | postmeiotic segregation increased 2 | | |
| 58, 148 | 56203 | ENSG00000163380 | LMOD3 | leiomodin 3 (fetal) | 0.3314 | 0.03082 |
| 59, 149 | 2101 | ENSG00000173153 | ESRRA | estrogen-related receptor alpha | 4.7284 | 0.03175 |
| 60, 150 | 373861 | ENSG00000188662 | HILS1 | histone linker H1 domain, spermatid-specific 1 | 0.3991 | 0.03194 |
| 61, 151 | 4212 | ENSG00000134138 | MEIS2 | Meis homeobox 2 | 0.3137 | 0.03345 |
| 62, 152 | 5636 | ENSG00000141127 | PRPSAP2 | phosphoribosyl pyrophosphate synthetase- | 0.1847 | 0.03423 |
| 63, 153 | 114827 | ENSG00000142621 | FHAD1 | forkhead-associated (FHA) phosphopeptide | 4.4247 | 0.03436 |
| 64, 154 | 92181 | ENSG00000168246 | UBTD2 | ubiquitin domain containing 2 | 0.2467 | 0.03498 |
| 65, 155 | 7067 | ENSG00000126351 | THRA | thyroid hormone receptor, alpha | 0.1797 | 0.03562 |
| 66, 156 | 139741 | ENSG00000123165 | ACTRT1 | actin-related protein T1 | 0.3739 | 0.03563 |
| 67, 157 | 55544 | ENSG00000132819 | RBM38 | RNA binding motif protein 38 | 4.1900 | 0.03581 |
| 68, 158 | 6388 | ENSG00000132581 | SDF2 | stromal cell-derived factor 2 | 0.2185 | 0.03615 |
| 69, 159 | 168975 | ENSG00000176571 | CNBD1 | cyclic nucleotide binding domain containing 1 | 0.1701 | 0.03643 |
| 70, 160 | 56257 | ENSG00000146834 | MEPCE | bin3, bicoid-interacting 3, homolog | 3.3279 | 0.03645 |
| 71, 161 | 55831 | ENSG00000125037 | TMEM111 | transmembrane protein 111 | 5.2241 | 0.03702 |
| 72, 162 | 5782 | ENSG00000127947 | PTPN12 | protein tyrosine phosphatase, non-receptor | 0.2185 | 0.03824 |
| 73, 163 | 7336 | ENSG00000169139 | UBE2V2 | ubiquitin-conjugating enzyme E2 variant 2 | 0.2215 | 0.04004 |
| 74, 164 | 22849 | ENSG00000107864 | CPEB3 | cytoplasmic polyadenylation element binding | 2.5130 | 0.04203 |
| 75, 165 | 8366 | ENSG00000124529 | HIST1H4B | histone 1, H4b | 2.4576 | 0.04207 |

FIGURE 1C

| Exemplified by SEQ ID NOS: | Entrez GeneID | Ensembl GeneID | Gene Symbol | Gene Name | abnormal/ normal | p-value |
|---|---|---|---|---|---|---|
| 76, 166 | 254531 | ENSG00000176454 | AGPAT7 | 1-acylglycerol-3-phosphate O-acyltransferase | 3.3807 | 0.04318 |
| 77, 167 | 81704 | ENSG00000107099 | DOCK8 | dedicator of cytokinesis 8 | 0.2787 | 0.04387 |
| 78, 168 | 143689 | ENSG00000134627 | PIWIL4 | piwi-like 4 | 0.2890 | 0.04439 |
| 79, 169 | 10336 | ENSG00000185619 | PCGF3 | polycomb group ring finger 3 | 4.8836 | 0.04479 |
| 80, 170 | 3158 | ENSG00000134240 | HMGCS2 | 3-hydroxy-3-methylglutaryl-Coenzyme A | 0.4403 | 0.04533 |
| 81, 171 | 259266 | ENSG00000066279 | ASPM | asp (abnormal spindle)-like, microcephaly | 0.2942 | 0.04578 |
| 82, 172 | 9948 | ENSG00000071127 | WDR1 | WD repeat domain 1 | 2.2581 | 0.04632 |
| 83, 173 | 83985 | ENSG00000169682 | SPNS1 | Spinster | 0.4638 | 0.04716 |
| 84, 174 | 51741 | ENSG00000186153 | WWOX | WW domain containing oxidoreductase | 4.9246 | 0.04778 |
| 85, 175 | 1576 | ENSG00000160868 | CYP3A4 | cytochrome P450, family 3, subfamily A, | 3.1504 | 0.04855 |
| 86, 176 | 9238 | ENSG00000136270 | TBRG4 | transforming growth factor beta regulator 4 | 0.3539 | 0.04901 |
| 87, 177 | 84666 | ENSG00000163515 | RETNLB | resistin like beta | 0.1210 | 0.00918 |
| 88, 178 | 10487 | ENSG00000131236 | CAP1 | CAP, adenylate cyclase-associated protein 1 | 2.1734 | 0.01121 |
| 89, 179 | 23175 | ENSG00000134324 | LPIN1 | lipin 1 | 0.4955 | 0.03730 |
| 90, 180 | 4850 | ENSG00000080802 | CNOT4 | CCR4-NOT transcription complex, subunit 4 | 9.1233 | 0.04524 |
| 91, 181 | 120329 | -- | CASP12 | caspase 12 | 0.2563 | 0.03776 |
| 92, 182 | 6611 | ENSG00000102172 | SMS | spermine synthase | 0.1262 | 0.02887 |
| | -- | -- | -- | Probe 131701 hybridizing Celera hCG2040689 | | |
| | -- | -- | -- | Probe 228780 hybridizing Celera hCG1987894 | | |
| | -- | -- | -- | Probe 705174 hybridizing Celera hCG2043502 | | |
| | -- | -- | -- | Probe 233419 hybridizing Celera hCG1644979 | | |

FIGURE 1D

| Exemplified by SEQ ID NOS: | Entrez GeneID | Ensembl GeneID | Gene Symbol | Gene Name | abnormal/ normal | p-value |
|---|---|---|---|---|---|---|
| 183, 283 | 4070 | ENSG00000184292 | TACSTD2 | tumor-associated calcium signal transducer 2 | 0.0575 | 0.00390 |
| 184, 284 | 5930 | ENSG00000122257 | RBBP6 | retinoblastoma binding protein 6 | 0.1509 | 0.00104 |
| 185, 285 | 148789 | ENSG00000162885 | B3GALNT2 | beta-1,3-N-acetylgalactosaminyltransferase 2 | 0.1520 | 0.00256 |
| 186, 286 | 79680 | ENSG00000215012 | FLJ21125 | chromosome 22 open reading frame 29 | 0.1526 | 0.00269 |
| 187, 287 | 6360 | ENSG00000161573 | CCL16 | chemokine (C-C motif) ligand 16 | 0.1580 | 0.00031 |
| 188, 288 | 1660 | ENSG00000135829 | DHX9 | DEAH (Asp-Glu-Ala-His) box polypeptide 9 | 0.1818 | 0.00714 |
| 189, 289 | 79075 | ENSG00000136982 | DCC1 | defective in sister chromatid cohesion homolog | 0.2015 | 0.00150 |
| 190, 290 | 55186 | ENSG00000114120 | SLC25A36 | solute carrier family 25, member 36 | 0.2200 | 0.00970 |
| 191, 291 | 285761 | ENSG00000164465 | DCBLD1 | discoidin, CUB and LCCL domain containing | 0.2311 | 0.00195 |
| 192, 292 | 55752 | ENSG00000138758 | SEPT11 | septin 11 | 0.2345 | 0.00892 |
| 193, 293 | 55593 | ENSG00000068308 | OTUD5 | OTU domain containing 5 | 0.2430 | 0.00730 |
| 194, 294 | 284047 | ENSG00000154874 | CCDC144B | coiled-coil domain containing 144B | 0.1529 | 0.01005 |
| 195, 295 | 3592 | ENSG00000168811 | IL12A | interleukin 12A | 0.0575 | 0.00390 |
| 196, 296 | 56675 | ENSG00000175352 | NRIP3 | nuclear receptor interacting protein 3 | 0.2843 | 0.00012 |
| 197, 297 | 136319 | ENSG00000105887 | MTPN | myotrophin | 0.3123 | 0.00508 |
| 198, 298 | 1464 | ENSG00000173546 | CSPG4 | chondroitin sulfate proteoglycan 4 | 0.3199 | 0.00274 |
| 199, 299 | 80149 | ENSG00000163874 | ZC3H12A | zinc finger CCCH-type containing 12A | 0.3347 | 0.00019 |
| 200, 300 | 56143 | ENSG00000204965 | PCDHA5 | protocadherin alpha 5 | 0.3401 | 0.00673 |
| 201, 301 | 8703 | ENSG00000158850 | B4GALT3 | UDP-Gal:betaGlcNAc beta 1,4- | 0.3414 | 0.00595 |
| 202, 302 | 116225 | ENSG00000165724 | ZMYND19 | zinc finger, MYND-type containing 19 | 0.3479 | 0.00889 |
| 203, 303 | 143425 | ENSG00000170743 | SYT9 | synaptotagmin IX | 0.3569 | 0.00040 |
| 204, 304 | 7027 | ENSG00000198176 | TFDP1 | transcription factor Dp-1 | 0.3621 | 0.00752 |
| 205, 305 | 55132 | ENSG00000138709 | LARP2 | La ribonucleoprotein domain family, member | 0.3740 | 0.00070 |
| 206, 306 | 8837 | ENSG00000003402 | CFLAR | CASP8 and FADD-like apoptosis regulator | 0.3798 | 0.00502 |
| 207, 307 | 51280 | ENSG00000135052 | GOLM1 | golgi membrane protein 1 | 0.3875 | 0.00093 |
| 208, 308 | 11202 | ENSG00000129455 | KLK8 | kallikrein-related peptidase 8 | 0.3899 | 0.00844 |

FIGURE 2A

| Exemplified by SEQ ID NOS: | Entrez GeneID | Ensembl GeneID | Gene Symbol | Gene Name | abnormal/ normal | p-value |
|---|---|---|---|---|---|---|
| 209, 309 | 3921 | ENSG00000168028 | RPSA15 | LOC388524 ribosomal protein SA | 0.3936 | 0.00603 |
| 210, 310 | 55182 | ENSG00000187147 | C1orf164 | chromosome 1 open reading frame 164 | 0.3983 | 0.00400 |
| 211, 311 | 23543 | ENSG00000100320 | RBM9 | RNA binding motif protein 9 | 0.4030 | 0.00599 |
| 212, 312 | 127253 | ENSG00000162623 | TYW3 | tRNA-yW synthesizing protein 3 homolog | 0.4182 | 0.00868 |
| 213, 313 | 594 | ENSG00000083123 | BCKDHB | branched chain keto acid dehydrogenase E1, | 0.4224 | 0.00851 |
| 214, 314 | 64663 | ENSG00000198573 | SPANXC | SPANX family, member C | 0.4278 | 0.00115 |
| 215 | -- | ENSG00000187832 | RPSA | ribosomal protein SA | 0.4380 | 0.00662 |
| 216, 315 | 115752 | ENSG00000166938 | DIS3L | DIS3 mitotic control homolog | 0.4479 | 0.00445 |
| 217, 316 | 9894 | ENSG00000100726 | TELO2 | TEL2, telomere maintenance 2, homolog | 0.4513 | 0.00911 |
| 218, 317 | 1019 | ENSG00000135446 | CDK4 | cyclin-dependent kinase 4 | 0.4608 | 0.00131 |
| 219, 318 | 7169 | ENSG00000198467 | TPM2 | tropomyosin 2 (beta) | 0.4612 | 0.00251 |
| 220, 319 | 127406 | ENSG00000188819 | LOC127406 | similar to laminin receptor 1 | 0.4623 | 0.00963 |
| 221, 320 | 91272 | ENSG00000145919 | FAM44B | family with sequence similarity 44, member B | 0.4627 | 0.00728 |
| 222, 321 | 171392 | ENSG00000197372 | ZNF675 | zinc finger protein 675 | 0.4648 | 0.00732 |
| 223, 322 | 308 | ENSG00000164111 | ANXA5 | annexin A5 | 0.4667 | 0.00530 |
| 224, 323 | 3340 | ENSG00000070614 | NDST1 | N-deacetylase/N-sulfotransferase (heparan | 0.4723 | 0.00603 |
| 225, 324 | 85459 | ENSG00000166004 | KIAA1731 | KIAA1731 | 0.4781 | 0.00723 |
| 226, 325 | 10482 | ENSG00000162231 | NXF1 | nuclear RNA export factor 1 | 0.4793 | 0.00267 |
| 227, 326 | 65987 | ENSG00000151364 | KCTD14 | potassium channel tetramerisation domain | 0.4817 | 0.00567 |
| 228, 327 | 11186 | ENSG00000068028 | RASSF1 | Ras association (RalGDS/AF-6) domain family | 0.4852 | 0.00142 |
| 229, 328 | 197021 | ENSG00000188501 | LCTL | lactase-like | 0.4984 | 0.00832 |
| 230, 329 | 3206 | ENSG00000153807 | HOXA10 | homeobox A10 | 3.6454 | 0.00537 |
| 231, 330 | 200261 | -- | LOC200261 | LOC200261 | 0.0535 | 0.01506 |
| 232, 331 | 23126 | ENSG00000143442 | POGZ | pogo transposable element with ZNF domain | 0.0590 | 0.01359 |
| 233, 332 | 60677 | ENSG00000140488 | BRUNOL6 | bruno-like 6, RNA binding protein | 0.1172 | 0.03122 |
| 234, 333 | 6935 | ENSG00000148516 | ZEB1 | zinc finger E-box binding homeobox 1 | 0.1395 | 0.01642 |

FIGURE 2B

| Exemplified by SEQ ID NOS: | Entrez GeneID | Ensembl GeneID | Gene Symbol | Gene Name | abnormal/ normal | p-value |
|---|---|---|---|---|---|---|
| 235, 334 | 55075 | ENSG00000137831 | UACA | uveal autoantigen with coiled-coil domains and | 0.1587 | 0.01652 |
| 236, 335 | 9473 | ENSG00000130775 | C1orf38 | chromosome 1 open reading frame 38 | 0.1603 | 0.04512 |
| 237, 336 | 54576 | ENSG00000167165 | UGT1A9 | UDP glucuronosyltransferase 1 family, | 0.1631 | 0.02645 |
| 238, 337 | -- | ENSG00000187667 | WHDC1L1 | WAS protein homology region 2 domain | 0.1695 | 0.04314 |
| 239, 338 | 440253 | -- | WHDC1L2 | WAS protein homology region 2 domain | 0.1695 | 0.04314 |
| 240, 339 | 63895 | ENSG00000154864 | FAM38B | FAM38B | 0.1712 | 0.02929 |
| 241, 340 | 55088 | ENSG00000165813 | C10orf118 | C10orf118 | 0.1808 | 0.03736 |
| 242, 341 | 983 | ENSG00000170312 | CDC2 | cyclin-dependent kinase 1 | 0.1944 | 0.01489 |
| 243, 342 | 6558 | ENSG00000064651 | SLC12A2 | solute carrier family 12 | 0.1949 | 0.02259 |
| 244, 343 | 54456 | ENSG00000073146 | MOV10L1 | Moloney leukemia virus 10-like 1 | 0.2002 | 0.04357 |
| 245, 344 | 5332 | ENSG00000101333 | PLCB4 | phospholipase C, beta 4 | 0.2124 | 0.02353 |
| 246, 345 | 23519 | ENSG00000139223 | ANP32D | acidic (leucine-rich) nuclear phosphoprotein 32 | 0.2140 | 0.02994 |
| 247, 346 | 653121 | ENSG00000160062 | ZBTB8 | zinc finger and BTB domain containing 8 | 0.2162 | 0.03949 |
| 248, 347 | 245802 | ENSG00000166926 | MS4A6E | membrane-spanning 4-domains, subfamily A, | 0.2182 | 0.03753 |
| 249, 348 | 341392 | ENSG00000215009 | LOC341392 | acyl-CoA synthetase medium-chain family | 0.2317 | 0.02346 |
| 250, 349 | 140688 | ENSG00000197183 | C20orf112 | chromosome 20 open reading frame 112 | 0.2338 | 0.01827 |
| 251, 350 | 57730 | ENSG00000187998 | LOC375251 | KIAA1641-like | 0.2346 | 0.02143 |
| 252, 351 | 84727 | ENSG00000111671 | SPSB2 | splA/ryanodine receptor domain and SOCS | 0.2368 | 0.03253 |
| 253, 352 | 55212 | ENSG00000138686 | BBS7 | Bardet-Biedl syndrome 7 | 0.2411 | 0.02927 |
| 254, 353 | 2048 | ENSG00000133216 | EPHB2 | EPH receptor B2 | 0.2478 | 0.01074 |
| 255, 354 | 54979 | ENSG00000133328 | HRASLS2 | HRAS-like suppressor 2 | 0.2577 | 0.01007 |
| 256, 355 | 81543 | ENSG00000160233 | LRRC3 | leucine rich repeat containing 3 | 0.2606 | 0.01893 |
| 257, 356 | 9662 | ENSG00000174799 | CEP135 | centrosomal protein 135kDa | 0.2617 | 0.04571 |
| 258, 357 | 124222 | ENSG00000162073 | PAQR4 | progestin and adipoQ receptor family member | 0.2715 | 0.03814 |
| 259, 358 | 54790 | ENSG00000168769 | KIAA1546 | KIAA1546 | 0.2721 | 0.04948 |
| 260, 359 | 7357 | ENSG00000148154 | UGCG | UDP-glucose ceramide glucosyltransferase | 0.2721 | 0.01173 |

FIGURE 2C

| Exemplified by SEQ ID NOS: | Entrez GeneID | Ensembl GeneID | Gene Symbol | Gene Name | abnormal/ normal | p-value |
|---|---|---|---|---|---|---|
| 261, 360 | 1553 | ENSG00000197838 | CYP2A13 | cytochrome P450, family 2, subfamily A, | 0.2725 | 0.04184 |
| 262, 361 | 10893 | ENSG00000125966 | MMP24 | matrix metallopeptidase 24 (membrane- | 0.2739 | 0.04106 |
| 263, 362 | 26267 | ENSG00000147912 | FBXO10 | F-box protein 10 | 0.2741 | 0.04768 |
| 264, 363 | 10450 | ENSG00000084072 | PPIE | peptidylprolyl isomerase E (cyclophilin E) | 0.2774 | 0.03494 |
| 265, 364 | 222166 | ENSG00000180354 | C7orf41 | chromosome 7 open reading frame 41 | 0.2815 | 0.03485 |
| 266, 365 | 29989 | ENSG00000171102 | OBP2B | odorant binding protein 2B | 0.2857 | 0.03155 |
| 267, 366 | 2318 | ENSG00000128591 | FLNC | filamin C, gamma (actin binding protein 280) | 0.2862 | 0.03826 |
| 268, 367 | 84313 | ENSG00000131475 | VPS25 | vacuolar protein sorting 25 homolog | 0.2878 | 0.03393 |
| 269, 368 | 59353 | ENSG00000126950 | TMEM35 | transmembrane protein 35 | 0.2885 | 0.02098 |
| 270, 369 | 9992 | ENSG00000159197 | KCNE2 | potassium voltage-gated channel, Isk-related | 0.2892 | 0.04245 |
| 271, 370 | 375748 | ENSG00000182150 | LOC375748 | RAD26L hypothetical protein | 0.2907 | 0.02333 |
| 272, 371 | 9486 | ENSG00000115526 | CHST10 | carbohydrate sulfotransferase 10 | 0.2948 | 0.03819 |
| 273, 372 | 51491 | ENSG00000048162 | U384 | HSPC111 | 0.2960 | 0.02762 |
| 274, 373 | 55219 | ENSG00000204178 | TMEM57 | transmembrane protein 57 | 0.2977 | 0.02216 |
| 275, 374 | 222236 | ENSG00000161048 | NAPE-PLD | N-acyl-phosphatidylethanolamine-hydrolyzing | 0.3009 | 0.01231 |
| 276, 375 | 55055 | ENSG00000174442 | ZWILCH | Zwilch, kinetochore associated, homolog | 0.3016 | 0.01698 |
| 277, 376 | 220136 | ENSG00000172361 | CCDC11 | coiled-coil domain containing 11 | 0.3065 | 0.03578 |
| 278, 377 | 4884 | ENSG00000171246 | NPTX1 | neuronal pentraxin I | 0.3088 | 0.03202 |
| 279, 378 | 223075 | ENSG00000133789 | SWAP70 | SWAP-70 protein | 0.3097 | 0.03146 |
| 280, 379 | 10396 | ENSG00000124406 | ATP8A1 | ATPase, aminophospholipid transporter | 0.3107 | 0.03182 |
| 281, 380 | 2624 | ENSG00000179348 | GATA2 | GATA binding protein 2 | 0.1712 | 0.02929 |
| 282 | -- | ENSG00000183427 | -- | ENSG00000183427 | 0.4291 | 0.00588 |

FIGURE 2D

ASSESSMENT OF OOCYTE COMPETENCE

CROSS-REFERENCE TO RELATED APPLICATIONS

This is a National Stage application of PCT International Application No. PCT/US2007/023216, filed Nov. 2, 2007, which in turn claims the benefit pursuant to 35 U.S.C. §119(e) of U.S. Provisional Application No. 60/856,157, filed on Nov. 2, 2006, which is hereby incorporated by reference in its entirety herein.

REFERENCE TO SEQUENCE LISTING

The Sequence Listing submitted on compact disk is hereby incorporated by reference. The file on the disk is named 047162-5031-00WO.txt. The file is 1657 kb and the date of creation is Nov. 2, 2007.

BACKGROUND OF THE INVENTION

Chromosome anomaly affects over 20% of oocytes obtained from women in their early thirties and this prevalence more than doubles as women enter their forties. These chromosome abnormalities are almost always lethal to the developing embryo and their high prevalence is responsible for many failed in vitro fertilization (IVF) treatments. Consequently the identification of chromosomally normal oocytes is of great importance for IVF treatment.

A number of clinical (e.g. preimplantation genetic diagnosis (PGD) and preimplantation genetic screening (PGS)) and scientific studies, employing various cytogenetic techniques, have demonstrated that in patients with indications for PGD and PGS, at least two-thirds of human preimplantation embryos contain aneuploid cells (Delhanty et al., 1997, Human Genetics 99:755-760; Munné and Cohen, 1998, Human Reproduction Update 4:842-855; Wells and Delhanty, 2000, Mol Hum Repro 6:1055-1062; Voullaire et al., 2002, Mol Hum Repro 8:1035-1041; Voullaire et al., 2000, Hum Gen 106:210-217; Coonen et al., 2001, Hum Repro 19:316-324; Baart et al., 2007, Prenatal Diag 27:55-63). It is has also been demonstrated that 85% of embryos produced in vitro and transferred into the uterus fail to develop into an infant, leaving only a small fraction destined to become a live birth (Kovalevsky and Patrizio, 2005, Fertility and Sterility 84:325-330). To address this low competence rate, usually multiple oocytes and embryos are produced during IVF. But to minimize the risk of a high-order multiple pregnancy (e.g. triplets, quads, etc) usually only 2 or 3 embryos are transferred to the uterus. A great challenge for physicians is identifying which embryos are the most likely to result in a pregnancy and ensure that these embryos are among the limited number selected for transfer to the uterus.

Methods for identifying healthy oocytes and embryos based upon morphological assessments have not been very successful (for review, see Patrizio et al., 2007, Repro Bio-Medicine Online 15:346-353). In addition to morphological assessments, some clinics also employ cytogenetic assessments. Oocytes can be tested for aneuploidy by biopsy of the first and second polar bodies and subjecting them to cytogenetic analysis. The detection of extra or missing chromosomes in a polar body is indicative of a reciprocal loss or gain of chromosomes in the corresponding oocyte. Embryos derived from chromosomally normal oocytes can be given priority for transfer during assisted reproduction, potentially improving outcome by avoiding transfer of embryos carrying deleterious aneuploidies. But, classical cytogenetic techniques are difficult to apply to polar bodies, due to problems of obtaining high quality chromosome spreads. For this reason, the vast majority of chromosomal tests performed on polar bodies have employed fluorescence in-situ hybridization (FISH). Using FISH, it is possible to assess 5-12 chromosomes in individual polar bodies/oocytes regardless of chromosome morphology (Verlinsky et al., 1998, J Assisted Repro & Gen 15:285-289; Kuliev et al., 2003, Repro Biomed Online 6:54-59; Pujol et al., 2003, Eur J Hum Gen 11:325-326). However, this method examines only less than half of the chromosomes. In addition, the removal of a cell is an invasive procedure that may damage the embryo.

More recently, comparative genomic hybridization (CGH) has been used to assess the copy number of chromosomes in polar bodies and oocytes, although to date most analyses have been performed in a research context (Wells et al., 2002, Fertility and Sterility 78:543-549; Gutierrez-Mateo et al., 2004, Hum Repro 19:2118-2125; Fragouli et al. 2006, Cyto Gen Res 114:30-38; Fragouli et al., 2006, Hum Repro 21:2319-2328). CGH has the major advantage that every chromosome is analyzed, rather than the limited subset assessed using FISH, but it is a time-consuming and labor-intensive method that is difficult to perform within the limited time available for preimplantation testing.

Studies conducting gene expression analysis using reverse transcription followed by real-time polymerase chain reaction (PCR) have found that specific genes display alterations in activity that may be related to oocyte or embryo quality and competence (Wells et al., 2005, Fertility and Sterility 84:343-355; Dode et al., 2006, Mol Repro Devel 73:288-297; Russell et al., 2006, Mol Repro Devel 73:1255-1270), and that morphologically abnormal preimplantation embryos frequently display atypical patterns of gene expression (Wells et al., 2005, Fertility and Sterility 84:343-355). Despite the accuracy and sensitivity of real-time PCR, the method is limited by the restricted number of genes that can be assessed for each oocyte or embryo, generally less than 10 genes.

Reproductive medicine would benefit greatly from a method capable of the noninvasive characterization and identification of those oocytes or embryos most likely to result in successful fertilization and implantation by measuring the level of marker expression associated with oocyte competence and oocyte incompetence. The present invention fulfills this need.

SUMMARY OF THE DISCLOSURE

The present invention contemplates a method of evaluating the competence of a mammalian oocyte for fertilization, or for implantation, or for both. In one embodiment the method comprises determining in a sample the level of marker expression of at least one nucleic acid selected from the group of nucleic acids exemplified by SEQ ID NOS:1-92 and 183-292, and comparing the level of marker expression in the sample with a control or reference standard, wherein detecting differential marker expression between the sample and the control is indicative of the competence of the oocyte for fertilization, or for implantation, or for both.

It is an aspect of the invention that the sample may be derived from an oocyte, follicular fluid, cumulus cell or culture medium. The control or reference standard may be derived from an oocyte competent for implantation, an oocyte not competent for implantation, an oocyte competent for fertilization, an oocyte not competent for fertilization, a chromosomally normal oocyte, a chromosomally abnormal oocyte, follicular fluid associated with an oocyte competent for implantation, follicular fluid associated with an oocyte not competent for implantation, follicular fluid associated with an oocyte competent for fertilization, follicular fluid associated with an oocyte not competent for fertilization, follicular fluid associated with a chromosomally normal oocyte, follicular fluid associated with a chromosomally abnormal oocyte, culture medium associated with an oocyte competent for implantation, culture medium associated with an oocyte not competent for implantation, culture medium associated with an oocyte competent for fertilization, culture medium associated with an oocyte not competent for fertilization, culture medium associated with a chromosomally normal oocyte, culture medium associated with a chromosomally abnormal oocyte, a cumulus cell associated with an oocyte competent for implantation, a cumulus cell associated with an oocyte not competent for implantation, a cumulus cell associated with an oocyte competent for fertilization, a cumulus cell associated with an oocyte not competent for fertilization, a cumulus cell associated with a chromosomally normal oocyte, a cumulus cell associated with a chromosomally abnormal oocyte, follicular fluid associated with a cumulus cell associated with an oocyte competent for implantation, follicular fluid associated with a cumulus cell associated with an oocyte not competent for implantation, follicular fluid associated with a cumulus cell associated with an oocyte competent for fertilization, follicular fluid associated with a cumulus cell associated with an oocyte not competent for fertilization, follicular fluid associated with a cumulus cell associated with a chromosomally normal oocyte, follicular fluid associated with a cumulus cell associated with a chromosomally abnormal oocyte, culture medium associated with a cumulus cell associated with an oocyte competent for implantation, culture medium associated with a cumulus cell associated with an oocyte not competent for implantation, culture medium associated with a cumulus cell associated with an oocyte competent for fertilization, culture medium associated with a cumulus cell associated with an oocyte not competent for fertilization, culture medium associated with a cumulus cell associated with a chromosomally normal oocyte, culture medium associated with a cumulus cell associated with a chromosomally abnormal oocyte or combinations thereof.

In one aspect, the level of marker expression determined in the sample is at least 20% different from the level of marker expression determined in the control or reference standard. In one aspect, the level of marker expression may be detected by nucleic acid microarray, Northern blot, or reverse transcription PCR. In another aspect, the level of marker expression may be detected by Western blot, enzyme-linked immunosorbent assay, protein microarray or FACS analysis.

It is an aspect of the invention that the oocyte and cumulus cell are human, but the oocyte and cumulus cell may also be of a domesticated mammal.

In another aspect, the invention comprises an array of nucleic acid probes immobilized on a solid support, the probe set comprising a plurality of probes, each probe comprising a segment of at least twenty nucleotides exactly complementary to a subsequence of a set of reference sequences, wherein the set of reference sequences comprises SEQ ID NOS:1-92.

In another aspect, the invention comprises an array of nucleic acid probes immobilized on a solid support, the probe set comprising a plurality of probes, each probe comprising a segment of at least twenty nucleotides exactly complementary to a subsequence of a set of reference sequences, wherein the set of reference sequences comprises SEQ ID NOS:183-282.

BRIEF DESCRIPTION OF THE DRAWINGS

FIG. 1A depicts a list of markers differentially expressed between chromosomally normal and chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

FIG. 1B depicts a list of markers differentially expressed between chromosomally normal and chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

FIG. 1C depicts a list of markers differentially expressed between chromosomally normal and chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

FIG. 1D depicts a list of markers differentially expressed between chromosomally normal and chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

FIG. 2A depicts a list of markers differentially expressed between cumulus cells associated with chromosomally normal oocytes and cumulus cells associated with chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

FIG. 2B depicts a list of markers differentially expressed between cumulus cells associated with chromosomally normal oocytes and cumulus cells associated with chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

FIG. 2C depicts a list of markers differentially expressed between cumulus cells associated with chromosomally normal oocytes and cumulus cells associated With chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

FIG. 2D depicts a list of markers differentially expressed between cumulus cells associated with chromosomally normal oocytes and cumulus cells associated with chromosomally abnormal oocytes. GeneID is a unique identifier assigned to a record in Entrez Gene. Entrez Gene provides these tracked, unique identifiers for genes and reports information associated with those identifiers for unrestricted public use at: www<dot>ncbi<dot>nlm<dot>nih<dot>gov/sites/entrez?db=gene. Ensembl Gene ID is a unique stable gene identifier of the Ensembl database, publicly available at: www<dot>ensembl<dot>org (see Hubbard et al., 2006, Nucleic Acids Res 00:D1).

DETAILED DESCRIPTION OF THE INVENTION

The present invention provides a method of distinguishing oocytes and embryos more likely to experience successful fertilization and implantation from oocytes and embryos less likely to experience successful fertilization and implantation by the analysis of marker expression. In one embodiment, the method is non-invasive and the oocytes or embryos identified as more likely to experience successful fertilization and implantation remain viable for implantation. In one embodiment, the method is non-damaging and the oocytes or embryos identified as more likely to experience successful fertilization and implantation remain viable for implantation.

In one embodiment, the assessment of marker expression in oocytes, cumulus cells, follicular fluid, or culture medium is used to assess the competence of an oocyte for implantation. The assessment may be performed before implantation, to assist in maximizing the implantation of chromosomally normal embryos or to assist in minimizing the implantation of chromosomally abnormal embryos.

In one embodiment, the assessment of marker expression in oocytes, cumulus cells, follicular fluid, or culture medium is used to assess the competence of an oocyte for fertilization. The assessment may be performed before fertilization, to assist in maximizing the generation of chromosomally normal embryos or to assist in minimizing the generation of chromosomally abnormal embryos.

In one embodiment, the assessment of marker expression in oocytes, cumulus cells, follicular fluid, or culture medium is used to assess the quality of an oocyte for fertilization, implantation or long-term storage for later use by, for example, freezing.

In one embodiment, the products of differentially expressed markers are used for in vitro assessment of oocyte aneuploidy. In one embodiment, markers, gene products, RNA, proteins, and metabolites are assessed in follicular fluid, cumulus cells, polar bodies, oocytes, embryos or culture media in which the oocytes, cumulus cells, or embryos are cultured.

In one aspect, the markers displaying differential expression are used to diagnose chromosome abnormality. The assessment of marker expression in oocytes or cumulus cells is used to optimize methods for ovarian stimulation. The assessment of marker expression in oocytes or cumulus cells is also used to modify or optimize an in vitro maturation medium. Further, the assessment of marker expression in oocytes or cumulus cells is used to assay the effects of toxicants on human oocytes.

Preferably, the oocytes, cumulus cells, and embryos are human. However, the oocytes, cumulus cells, and embryos may be obtained from other non-human animals, preferably, domesticated animals.

The assessment of marker expression in oocytes or cumulus cells may be used to assist the proper function of affected gene expression pathways by modifying the levels of components in culture media to, for example, optimize ovarian stimulation.

The assessment of marker expression in oocytes or cumulus cells may be used to guide the design of culture media, which supports proper chromosome segregation and minimizes chromosome/chromatid imbalance to, for example, optimize ovarian stimulation.

The assessment of marker expression in oocytes or cumulus cells may be used, for example, to guide the design of dietary supplements, to reduce the chance of abnormal oocytes being formed, to improve fertility, to increase the number of years that a female remains fertile, and to reduce the risk of chromosomal conditions such as, for example, Down syndrome.

The invention contemplates the use of methods for the identification of differentially expressed markers of chromosome normality and abnormality and differentially expressed markers of oocyte competence and incompetence, as well as methods for the detection of the expression products of differentially expressed markers of chromosome normality and abnormality and differentially expressed markers of oocyte competence and incompetence.

The invention contemplates the identification of differentially expressed markers by whole genome nucleic acid microarray, to identify markers differentially expressed between oocytes competent for implantation and oocytes not competent for implantation. The invention further contemplates using methods known to those skilled in the art to detect and to measure the level of differentially expressed marker expression products, such as RNA and protein, to measure the level of one or more differentially expressed marker expression products in an oocyte, as well as follicular fluid, cumulus cells, and culture medium associated with an oocyte, to evaluate the chromosomal and genetic competence of the oocyte and its potential for implantation.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as Genome Analysis: A Laboratory Manual Series (Vols. I-IV), Using Antibodies: A Laboratory Manual, Cells: A Laboratory Manual, PCR Primer: A Laboratory Manual, and Molecular Cloning: A Laboratory Manual (all from Cold Spring Harbor Laboratory Press); Stryer, L., 1995, Biochemistry (4th Ed.) Freeman, New York; Gait, 1984, "Oligonucleotide Synthesis: A Practical Approach," IRL Press, London, Nelson and Cox;

Lehninger, Principles of Biochemistry 3rd Ed., W.H. Freeman Pub., New York, N.Y.; and Berg et al., 2002, Biochemistry, 5th Ed., W.H. Freeman Pub., New York, N.Y., all of which are herein incorporated in their entirety by reference for all purposes.

Nucleic acid arrays that are useful in the present invention include arrays such as those commercially available from Affymetrix (Santa Clara, Calif.) (example arrays are shown on the website at www<dot>affymetrix<dot>com), and from Applied Biosystems (Foster City, Calif.) (example arrays are shown on the website at www2<dot>appliedbiosystems<dot>com), and from Agilent Technologies (Santa Clara, Calif.) (example arrays are shown on the website at www<dot>home<dot>agilent<dot>com), and the like.

The present invention also contemplates sample preparation methods in certain embodiments. Prior to or concurrent with marker expression analysis, the expression product sample may be amplified using a variety of mechanisms, some of which may employ PCR. See, for example, PCR Technology: Principles and Applications for DNA Amplification (Ed. H. A. Erlich, Freeman Press, NY, N.Y., 1992); PCR Protocols: A Guide to Methods and Applications (Eds. Innis, et al., Academic Press, San Diego, Calif., 1990); Mattila et al., Nucleic Acids Res. 19, 4967 (1991); Eckert et al., PCR Methods and Applications 1, 17 (1991); PCR (Eds. McPherson et al., IRL Press, Oxford); and U.S. Pat. Nos. 4,683,202, 4,683,195, 4,800,159, 4,965,188, and 5,333,675, each of which is incorporated herein by reference in their entireties for all purposes.

Other suitable amplification methods include the ligase chain reaction (LCR) (for example, Wu and Wallace, Genomics 4, 560 (1989), Landegren et al., Science 241, 1077 (1988) and Barringer et al. Gene 89:117 (1990)), transcription amplification (Kwoh et al., Proc. Natl. Acad. Sci. USA 86, 1173 (1989) and WO88/10315), self-sustained sequence replication (Guatelli et al., Proc. Nat. Acad. Sci. USA, 87, 1874 (1990) and WO90/06995), selective amplification of target polynucleotide sequences (U.S. Pat. No. 6,410,276), consensus sequence primed PCR (CP-PCR) (U.S. Pat. No. 4,437,975), arbitrarily primed PCR (AP-PCR) (U.S. Pat. Nos. 5,413,909, 5,861,245), degenerate oligonucleotide primed PCR (DOP-PCR) (Wells et al., 1999, Nuc Acids Res 27:1214-1218) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described in Dong et al., Genome Research 11, 1418 (2001), in U.S. Pat. Nos. 6,361,947, 6,391,592 and U.S. Ser. Nos. 09/916,135, 09/920,491 (US Patent Application Publication 20030096235), U.S. Ser. No. 09/910,292 (US Patent Application Publication 20030082543), and U.S. Ser. No. 10/013,598.

Methods for conducting polynucleotide hybridization assays, for example, but not limited to northern blots, southern blots, and nucleic acid microarrays, have been developed in the art. Hybridization assay procedures and conditions will vary depending on the application and are selected in accordance with the general binding methods known including those referred to in: Maniatis et al. Molecular Cloning: A Laboratory Manual (2.sup.nd Ed. Cold Spring Harbor, N.Y., 1989); Berger and Kimmel Methods in Enzymology, Vol. 152, Guide to Molecular Cloning Techniques (Academic Press, Inc., San Diego, Calif., 1987); Young and Davism, P.N.A.S, 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference.

The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Ser. No. 10/389,194 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800,992, 5,834,758, 5,856,092, 5,902,723, 5,936,324, 5,981,956, 6,025,601, 6,090,555, 6,141,096, 6,185,030, 6,201,639; 6,218,803; and 6,225,625, in U.S. Ser. Nos. 10/389,194, 60/493,495 and in PCT Application PCT/US99/06097 (published as WO99/47964), each of which also is hereby incorporated by reference in its entirety for all purposes.

The practice of the present invention may also employ software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, for example Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., 2.sup.nd ed., 2001). See U.S. Pat. No. 6,420,108.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170. Additionally, the present invention may have preferred embodiments that include methods for providing genetic information over networks such as the Internet as shown in U.S. Ser. Nos. 10/197,621, 10/063,559 (US Pub No 20020183936), U.S. Ser. Nos. 10/065,856, 10/065,868, 10/328,818, 10/328,872, 10/423,403, and 60/482,389.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

In one embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, PCR with labeled primers or labeled nucleotides will provide a labeled amplification product. In another embodiment, transcription amplification, as described above, using a labeled nucleotide (e.g. fluorescein-labeled UTP and/or CTP) incorporates a label into the transcribed nucleic acids. In another embodiment PCR amplification products are fragmented and labeled by terminal deoxytransferase and labeled dNTPs. Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example, nick translation or end-labeling (e.g. with a labeled RNA) by kinasing the nucleic acid and subsequent attachment (ligation) of a nucleic acid linker joining the sample nucleic acid to a label (e.g., a fluorophore). In another embodiment label is added to the end of fragments using terminal deoxytransferase.

Detectable labels suitable for use in the present invention include any composition detectable by spectroscopic, photochemical, biochemical, immunochemical, electrical, optical or chemical means. Useful labels in the present invention include, but are not limited to: biotin for staining with labeled streptavidin conjugate; anti-biotin antibodies, magnetic beads (e.g., Dynabeads™); fluorescent dyes (e.g., fluorescein, texas red, rhodamine, green fluorescent protein, and the like); radiolabels (e.g., $^3H$, $^{125}I$, $^{35}S$, $^{4}C$, or $^{32}P$); phosphorescent labels; enzymes (e.g., horse radish peroxidase, alkaline phosphatase and others commonly used in an ELISA); and colorimetric labels such as colloidal gold or colored glass or plastic (e.g., polystyrene, polypropylene, latex, etc.) beads. Patents teaching the use of such labels include U.S. Pat. Nos. 3,817,837, 3,850,752, 3,939,350, 3,996,345, 4,277,437, 4,275,149 and 4,366,241, each of which is hereby incorporated by reference in its entirety for all purposes.

Means of detecting such labels are well known to those of skill in the art. Thus, for example, radiolabels may be detected using photographic film or scintillation counters; fluorescent markers may be detected using a photodetector to detect emitted light. Enzymatic labels are typically detected by providing the enzyme with a substrate and detecting the reaction product produced by the action of the enzyme on the substrate, and calorimetric labels are detected by simply visualizing the colored label.

A variety of immunoassay formats, including competitive and non-competitive immunoassay formats, antigen capture assays, two-antibodyسندwich assays, and three-antibody sandwich assays are useful methods of the invention (Self et al., 1996, Curr. Opin. Biotechnol. 7:60-65). The invention should not be construed to be limited to any one type of known or as yet unknown immunoassay.

In one embodiment, the method of the invention relies on one or more antigen capture assays. In one such antigen capture assay, antibody is bound to a solid support, and sample is added such that antigen is bound by the antibody. After unbound proteins are removed by washing, the amount of bound antigen can be quantified, if desired, using, for example, but not limited to, a radioassay (Harlow et al., 1989, Antibodies: A Laboratory Manual Cold Spring Harbor Laboratory, New York).

Enzyme-linked immunosorbent assays (ELISAs) are useful in the methods of the invention. An enzyme such as, but not limited to, horseradish peroxidase (HRP), alkaline phosphatase (AP), beta-galactosidase or urease can be linked, for example, to an antigen antibody or to a secondary antibody for use in a method of the invention. A horseradish-peroxidase detection system may be used, for example, with the chromogenic substrate tetramethylbenzidine (TMB), which yields a soluble product in the presence of hydrogen peroxide that is detectable at 450 nm. Other convenient enzyme-linked systems include, for example, the alkaline phosphatase detection system, which may be used with the chromogenic substrate p-nitrophenyl phosphate to yield a soluble product readily detectable at 405 nm. Similarly, a beta-galactosidase detection system may be used with the chromogenic substrate o-nitrophenyl-beta-D-galactopyranoside (ONPG) to yield a soluble product detectable at 410 nm. Alternatively, a urease detection system may be used with a substrate such as urea-bromocresol purple (Sigma Immunochemicals, St. Louis, Mo.). Useful enzyme-linked primary and secondary antibodies can be obtained from any number of commercial sources.

Chemiluminescent detection is also useful for detecting antigen or for determining a quantity of antigen according to a method of the invention. Chemiluminescent secondary antibodies may be obtained from any number of commercial sources. Fluorescent detection is also useful for detecting antigen or for determining a level of antigen in a method of the invention. Useful fluorochromes include, but are not limited to, DAPI, fluorescein, Hoechst 33258, R-phycocyanin, B-phycoerythrin, R-phycoerythrin, rhodamine, Texas red and lissamine-Fluorescein- or rhodamine-labeled antigen-specific antibodies.

Radioimmunoassays (RIAs) are also useful in the methods of the invention. Such assays are well known in the art, and are described for example in Brophy et al. (1990, Biochem. Biophys. Res. Comm. 167:898-903) and Guechot et al. (1996, Clin. Chem. 42:558-563). Radioimmunoassays are performed, for example, using Iodine-125-labeled primary or secondary antibody (Harlow et al., supra, 1999).

A signal emitted from a detectable antibody is analyzed, for example, using a spectrophotometer to detect color from a chromogenic substrate; a radiation counter to detect radiation, such as a gamma counter for detection of Iodine-125; or a fluorometer to detect fluorescence in the presence of light of a certain wavelength. Where an enzyme-linked assay is used, quantitative analysis of the amount of antigen is performed using a spectrophotometer. It is understood that the assays of the invention can be performed manually or, if desired, can be automated and that the signal emitted from multiple samples can be detected simultaneously in many systems available commercially.

The methods of the invention also encompass the use of capillary electrophoresis based immunoassays (CEIA), which can be automated, if desired. Immunoassays also may be used in conjunction with laser-induced fluorescence as described, for example, in Schmalzing et al. (1997, Electrophoresis 18:2184-2193) and Bao (1997, J. Chromatogr. B. Biomed. Sci. 699:463-480). Liposome immunoassays, such as flow-injection liposome immunoassays and liposome immunosensors, may also be used to detect antigen according to the methods of the invention (Rongen et al., 1997, J. Immunol. Methods 204:105-133).

Sandwich enzyme immunoassays may also be useful in the methods of the invention. In a two-antibody sandwich assay, a first antibody is bound to a solid support, and the antigen is allowed to bind to the first antibody. The amount of antigen is quantified by detecting and measuring the amount of a detectable second antibody that binds to the complex of the antigen and the first antibody. In a three-antibody sandwich assay, a first antibody is bound to a solid support, and the antigen is allowed to bind to the first antibody. Then a second antibody is added and is allowed to bind to the antigen, which is bound to the first antibody. The amount of antigen is quantified by detecting and measuring the amount of a detectable third antibody that binds to the second antibody.

Quantitative western blotting may also be used to detect antigen or to determine a level of antigen in a method of the invention. Western blots are quantified using well known methods such as scanning densitometry (Parra et al., 1998, J. Vasc. Surg. 28:669-675). Fluorescence activated cell sorting (FACS) analysis may also be used to detect antigen or to determine the level of antigen in a method of the invention. Using FACS analysis, cells may be stained with one or more fluorescent dyes specific to cell components of interest, and fluorescence of each cell is measured as it rapidly transverses the excitation beam (laser or mercury arc lamp). Fluorescence provides a quantitative measure of various biochemical and biophysical properties of the cell, as well as a basis for cell sorting. Other measurable optical parameters include light absorption and light scattering, the latter being applicable to the measurement of cell size, shape, density, granularity, and stain uptake (see Darzynkiewicz et al., 2004, Cytometry (4th ed), Academic Press, Burlington, Mass.).

DEFINITIONS

The articles "a" and "an" are used herein to refer to one or to more than one (i.e. to at least one) of the grammatical object of the article. By way of example, "an element" means one element or more than one element.

As used herein, "homologous" refers to the subunit sequence similarity between two polymeric molecules, e.g., between two nucleic acid molecules, e.g., two DNA molecules or two RNA molecules, or between two polypeptide molecules. When a subunit position in both of the two molecules is occupied by the same monomeric subunit, e.g., if a position in each of two DNA molecules is occupied by adenine, then they are homologous at that position. The homology between two sequences is a direct function of the number of matching or homologous positions, e.g., if half (e.g., five positions in a polymer ten subunits in length) of the positions in two compound sequences are homologous then the two sequences are 50% homologous, if 90% of the positions, e.g., 9 of 10, are matched or homologous, the two sequences share 90% homology. By way of example, the DNA sequences 3'ATTGCC5' and 3'TATGGC share 50% homology.

As used herein, "homology" is used synonymously with "identity." In addition, when the term "homology" is used herein to refer to the nucleic acids and proteins, it should be construed to be applied to homology at both the nucleic acid and the amino acid levels. The determination of percent identity between two nucleotide or amino acid sequences can be accomplished using a mathematical algorithm. For example, a mathematical algorithm useful for comparing two sequences is the algorithm of Karlin and Altschul (1990, Proc. Natl. Acad. Sci. USA 87:2264-2268), modified as in Karlin and Altschul (1993, Proc. Natl. Acad. Sci. USA 90:5873-5877). This algorithm is incorporated into the NBLAST and XBLAST programs of Altschul, et al. (1990, J. Mol. Biol. 215:403-410), and can be accessed, for example, at the National Center for Biotechnology Information (NCBI) world wide web site having the universal resource locator www<dot>ncbi<dot>nlm<dot>nih<dot>gov/BLAST/. BLAST nucleotide searches can be performed with the NBLAST program (designated "blastn" at the NCBI web site), using the following parameters: gap penalty=5; gap extension penalty=2; mismatch penalty=3; match reward=1; expectation value 10.0; and word size=11 to obtain nucleotide sequences homologous to a nucleic acid described herein. BLAST protein searches can be performed with the XBLAST program (designated "blastn" at the NCBI web site) or the NCBI "blastp" program, using the following parameters: expectation value 10.0, BLOSUM62 scoring matrix to obtain amino acid sequences homologous to a protein molecule described herein.

To obtain gapped alignments for comparison purposes, Gapped BLAST can be utilized as described in Altschul et al. (1997, Nucleic Acids Res. 25:3389-3402). Alternatively, PSI-Blast or PHI-Blast can be used to perform an iterated search which detects distant relationships between molecules (id.) and relationships between molecules which share a common pattern. When utilizing BLAST, Gapped BLAST, PSI-Blast, and PHI-Blast programs, the default parameters of the respective programs (e.g., XBLAST and NBLAST) can be used. See www<dot>ncbi<dot>nlm<dot>nih<dot>gov. The percent identity between two sequences can be determined using techniques similar to those described above, with or without allowing gaps. In calculating percent identity, typically exact matches are counted.

The term "antibody," as used herein, refers to an immunoglobulin molecule which is able to specifically bind to a specific epitope on an antigen. Antibodies can be intact immunoglobulins derived from natural sources or from recombinant sources and can be immunoreactive portions of intact immunoglobulins. Antibodies are typically tetramers of immunoglobulin molecules. The antibodies in the present invention may exist in a variety of forms including, for example, polyclonal antibodies, monoclonal antibodies, Fv, Fab and F(ab)2, as well as single chain antibodies and humanized antibodies (Harlow et al., 1999, Using Antibodies: A Laboratory Manual, Cold Spring Harbor Laboratory Press, New York; Harlow et al., 1989, Antibodies: A Laboratory Manual, Cold Spring Harbor, N.Y.; Houston et al., 1988, Proc. Natl. Acad. Sci. USA 85:5879-5883; Bird et al., 1988, Science 242:423-426).

By the term "specifically bind" or "specifically binds," as used herein, is meant that the antibody preferentially binds to a particular antigenic epitope, but does not necessarily bind only to that particular antigenic epitope.

The term "isolated antibody," as used herein, refers to an antibody that has been separated from that with which it is naturally associated in an organism.

The term "synthetic antibody," as used herein, refers to an antibody which is generated using recombinant DNA technology, such as, for example, an antibody expressed by a bacteriophage as described herein. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using synthetic DNA or amino acid sequence technology which is available and well known in the art.

As used herein, the term "heavy chain antibody" or "heavy chain antibodies" comprises immunoglobulin molecules derived from camelid species, either by immunization with an antigen and subsequent isolation of sera, or by the cloning and expression of nucleic acid sequences encoding such antibodies. The term "heavy chain antibody" or "heavy chain antibodies" further encompasses immunoglobulin molecules isolated from an animal with heavy chain disease, or prepared by the cloning and expression of $V_H$ (variable heavy chain immunoglobulin) genes from an animal.

As used herein a "probe" is defined as a nucleic acid capable of binding to a target nucleic acid of complementary sequence through one or more types of chemical bonds, usually through complementary base pairing, usually through hydrogen bond formation. As used herein, a probe may include natural (i.e. A, G, U, C, or T) or modified bases (7-deazaguanosine, inosine, etc.). In addition, a linkage other than a phosphodiester bond may join the bases in probes, so long as it does not interfere with hybridization. Thus, probes may be peptide nucleic acids in which the constituent bases are joined by peptide bonds rather than phosphodiester linkages.

The term "match," "perfect match," "perfect match probe" or "perfect match control" refers to a nucleic acid that has a sequence that is perfectly complementary to a particular target sequence. The nucleic acid is typically perfectly complementary to a portion (subsequence) of the target sequence. A perfect match (PM) probe can be a "test probe", a "normalization control" probe, an expression level control probe and the like. A perfect match control or perfect match is, however, distinguished from a "mismatch" or "mismatch probe."

The term "mismatch," "mismatch control" or "mismatch probe" refers to a nucleic acid whose sequence is not perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at or near the center of the probe such that the mismatch is most likely to destabilize the duplex with the target sequence under the test hybridization conditions.

A homo-mismatch substitutes an adenine (A) for a thymine (T) and vice versa and a guanine (G) for a cytosine (C) and vice versa. For example, if the target sequence was: AGGTCCA, a probe designed with a single homo-mismatch at the central, or fourth position, would result in the following sequence: TCCTGGT.

In one embodiment, pairs are present in perfect match and mismatch pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes indicate whether hybridization is or is not specific. For example, if the target is present, the perfect match probes should be consistently brighter than the mismatch probes because fluorescence intensity, or brightness, corresponds to binding affinity. (See e.g., U.S. Pat. No. 5,324,633, which is incorporated herein for all purposes.) Finally, the difference in intensity between the perfect match and the mismatch probe (I(PM)−I(MM)) provides a good measure of the concentration of the hybridized material. See PCT No WO 98/11223, which is incorporated herein by reference for all purposes.

Nucleic acids according to the present invention may include any polymer or oligomer of pyrimidine and purine bases, preferably cytosine, thymine, and uracil, and adenine and guanine, respectively. (See Albert L. Lehninger, Principles of Biochemistry, at 793-800 (Worth Pub. 1982) which is herein incorporated in its entirety for all purposes). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

An "oligonucleotide" or "polynucleotide" is a nucleic acid ranging from at least 2, preferably at least 8, 15 or 25 nucleotides in length, but may be up to 50, 100, 1000, or 5000 nucleotides long or a compound that specifically hybridizes to a polynucleotide. Polynucleotides include sequences of deoxyribonucleic acid (DNA) or ribonucleic acid (RNA) or mimetics thereof which may be isolated from natural sources, recombinantly produced or artificially synthesized. A further example of a polynucleotide of the present invention may be a peptide nucleic acid (PNA). (See U.S. Pat. No. 6,156,501 which is hereby incorporated by reference in its entirety.) The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this disclosure.

A "genome" is all the genetic material of an organism. In some instances, the term genome may refer to the chromosomal DNA. Genome may be multichromosomal such that the DNA is cellularly distributed among a plurality of individual chromosomes. For example, in human there are 22 pairs of chromosomes plus a gender associated XX or XY pair. DNA derived from the genetic material in the chromosomes of a particular organism is genomic DNA. The term genome may also refer to genetic materials from organisms that do not have chromosomal structure. In addition, the term genome may refer to mitochondria DNA. A genomic library is a collection of DNA fragments representing the whole or a portion of a genome. Frequently, a genomic library is a collection of clones made from a set of randomly generated, sometimes overlapping DNA fragments representing the entire genome or a portion of the genome of an organism.

The term "chromosome" refers to the heredity-bearing gene carrier of a cell which is derived from chromatin and which comprises DNA and protein components (especially histones). The conventional internationally recognized individual human genome chromosome numbering system is employed herein. The size of an individual chromosome can vary from one type to another within a given multi-chromosomal genome and from one genome to another. In the case of the human genome, the entire DNA mass of a given chromosome is usually greater than about 100,000,000 bp. For example, the size of the entire human genome is about $3 \times 10^9$ bp. The largest chromosome, chromosome no. 1, contains about $2.4 \times 10^8$ bp while the smallest chromosome, chromosome no. 22, contains about $5.3 \times 10^7$ bp.

A "chromosomal region" is a portion of a chromosome. The actual physical size or extent of any individual chromosomal region can vary greatly. The term "region" is not necessarily definitive of a particular one or more genes because a region need not take into specific account the particular coding segments (exons) of an individual gene.

An "allele" refers to one specific form of a genetic sequence (such as a gene) within a cell, an individual or within a population, the specific form differing from other forms of the same gene in the sequence of at least one, and frequently more than one, variant sites within the sequence of the gene. The sequences at these variant sites that differ between different alleles are termed "variants", "polymorphisms", or "mutations".

Polymorphism refers to the occurrence of two or more genetically determined alternative sequences or alleles in a population. A polymorphic marker or site is the locus at which divergence occurs. A polymorphism may comprise one or more base changes, an insertion, a repeat, or a deletion. A polymorphic locus may be as small as one base pair. The first identified allelic form is arbitrarily designated as the reference form and other allelic forms are designated as alternative or variant alleles. The allelic form occurring most frequently in a selected population is sometimes referred to as the wildtype form. A diallelic polymorphism has two forms. A triallelic polymorphism has three forms. A polymorphism between two nucleic acids can occur naturally, or be caused by exposure to or contact with chemicals, enzymes, or other agents, or exposure to agents that cause damage to nucleic acids, for example, ultraviolet radiation, mutagens or carcinogens.

Single nucleotide polymorphisms (SNPs) are positions at which two alternative bases occur at appreciable frequency (about at least 1%) in a given population. A SNP may arise due to substitution of one nucleotide for another at the polymorphic site. A transition is the replacement of one purine by another purine or one pyrimidine by another pyrimidine. A transversion is the replacement of a purine by a pyrimidine or vice versa. SNPs can also arise from a deletion of a nucleotide or an insertion of a nucleotide relative to a reference allele.

The term "genotyping" refers to the determination of the genetic information an individual carries at one or more positions in the genome. For example, genotyping may comprise the determination of which allele or alleles an individual carries for a single SNP or the determination of which allele or alleles an individual carries for a plurality of SNPs. For example, a particular nucleotide in a genome may be an A in some individuals and a C in other individuals. Those individuals who have an A at the position have the A allele and those who have a C have the C allele. A polymorphic location may have two or more possible alleles and the array may be designed to distinguish between all possible combinations.

The term "marker expression" as used herein, encompasses the transcription, translation, post-translation modification, and phenotypic manifestation of a gene, including all aspects of the transformation of information encoded in a gene into RNA or protein. By way of non-limiting example, marker expression includes transcription into messenger RNA (mRNA) and translation into protein, as well as transcription into types of RNA such as transfer RNA (tRNA) and ribosomal RNA (rRNA) that are not translated into protein.

By the phrase "determining the level of marker expression" is meant an assessment of the degree of expression of a marker in a sample at the nucleic acid or protein level, using technology available to the skilled artisan to detect a sufficient portion of any marker expression product (including nucleic acids and proteins) of any one of the sequences listed herein in the accompanying sequence listing, such that the sufficient portion of the marker expression product detected is indicative of the expression of any one of the sequences listed herein in the accompanying sequence listing.

The term "control or reference standard" describes a material comprising none, or a normal, low, or high level of one of more of the marker expression products of one or more of the sequences listed herein in the accompanying sequence listing, such that the control or reference standard may serve as a comparator against which a sample can be compared. By way of non-limiting examples, a control or reference standard may include all or a part of any of an oocyte competent for implantation, an oocyte not competent for implantation, an oocyte competent for fertilization, an oocyte not competent for fertilization, a chromosomally normal oocyte, a chromosomally abnormal oocyte, follicular fluid associated with an oocyte competent for implantation, follicular fluid associated with an oocyte not competent for implantation, follicular fluid associated with an oocyte competent for fertilization, follicular fluid associated with an oocyte not competent for fertilization, follicular fluid associated with a chromosomally normal oocyte, follicular fluid associated with a chromosomally abnormal oocyte, culture medium associated with an oocyte competent for implantation, culture medium associated with an oocyte not competent for implantation, culture medium associated with an oocyte competent for fertilization, culture medium associated with an oocyte not competent for fertilization, culture medium associated with a chromosomally normal oocyte, culture medium associated with a chromosomally abnormal oocyte, a cumulus cell associated with an oocyte competent for implantation, a cumulus cell associated with an oocyte not competent for implantation, a cumulus cell associated with an oocyte competent for fertilization, a cumulus cell associated with an oocyte not competent for fertilization, a cumulus cell associated with a chromosomally normal oocyte, a cumulus cell associated with a chromosomally abnormal oocyte, follicular fluid associated with a cumulus cell associated with an oocyte competent for implantation, follicular fluid associated with a cumulus cell associated with an oocyte not competent for implantation, follicular fluid associated with a cumulus cell associated with an oocyte competent for fertilization, follicular fluid associated with a cumulus cell associated with an oocyte not competent for fertilization, follicular fluid associated with a cumulus cell associated with a chromosomally normal oocyte, follicular fluid associated with a cumulus cell associated with a chromosomally abnormal oocyte, culture medium associated with a cumulus cell associated with an oocyte competent for implantation, culture medium associated with a cumulus cell associated with an oocyte not competent for implantation, culture medium associated with a cumulus cell associated with an oocyte competent for fertilization, culture medium associated with a cumulus cell associated with an oocyte not competent for fertilization, culture medium associated with a cumulus cell associated with a chromosomally normal oocyte, culture medium associated with a cumulus cell associated with a chromosomally abnormal oocyte or combinations thereof.

An "array" comprises a support, preferably solid, with nucleic acid probes attached to the support. Preferred arrays typically comprise a plurality of different nucleic acid probes that are coupled to a surface of a substrate in different, known locations. These arrays, also described as "microarrays" or colloquially "chips" have been generally described in the art, for example, U.S. Pat. Nos. 5,143,854, 5,445,934, 5,744,305, 5,677,195, 5,800,992, 6,040,193, 5,424,186 and Fodor et al., 1991, Science, 251:767-777, each of which is incorporated by reference in its entirety for all purposes. Arrays may generally be produced using a variety of techniques, such as mechanical synthesis methods or light directed synthesis methods that incorporate a combination of photolithographic methods and solid phase synthesis methods. Techniques for the synthesis of these arrays using mechanical synthesis methods are described in, e.g., U.S. Pat. Nos. 5,384,261, and 6,040,193, which are incorporated herein by reference in their entirety for all purposes. Although a planar array surface is preferred, the array may be fabricated on a surface of virtually any shape or even a multiplicity of surfaces. Arrays may be nucleic acids on beads, gels, polymeric surfaces, fibers such as fiber optics, glass or any other appropriate substrate. (See U.S. Pat. Nos. 5,770,358, 5,789,162, 5,708,153, 6,040,193 and 5,800,992, which are hereby incorporated by reference in their entirety for all purposes.)

Assays for amplification of the known sequence are also disclosed. For example primers for long range PCR may be designed to amplify regions of the sequence. For RNA, a first reverse transcriptase step may be used to generate double stranded DNA from the single stranded RNA. The array may be designed to detect sequences from an entire genome; or one or more regions of a genome, for example, selected regions of a genome such as those coding for a protein or RNA of interest; or a conserved region from multiple genomes; or multiple genomes, Arrays and methods of genetic analysis using arrays is described in Cutler, et al., 2001, Genome Res. 11(11): 1913-1925 and Warrington, et al., 2002, Hum Mutat 19:402-409 and in US Patent Pub No 20030124539, each of which is incorporated herein by reference in its entirety.

Arrays may be packaged in such a manner as to allow for diagnostic use or can be an all-inclusive device; e.g., U.S. Pat. Nos. 5,856,174 and 5,922,591 incorporated in their entirety by reference for all purposes. Arrays are commercially available from, for example, Affymetrix (Santa Clara, Calif.) and Applied Biosystems (Foster City, Calif.), and are directed to a variety of purposes, including genotyping, diagnostics, mutation analysis, marker expression, and gene expression monitoring for a variety of eukaryotic and prokaryotic organisms. The number of probes on a solid support may be varied by changing the size of the individual features. In one embodiment the feature size is 20 by 25 microns square, in other embodiments features may be, for example, 8 by 8, 5 by 5 or 3 by 3 microns square, resulting in about 2,600,000, 6,600,000 or 18,000,000 individual probe features.

Hybridization probes are oligonucleotides capable of binding in a base-specific manner to a complementary strand of nucleic acid. Such probes include peptide nucleic acids, as described in Nielsen et al., 1991, Science 254, 1497-1500, and other nucleic acid analogs and nucleic acid mimetics. See U.S. Pat. No. 6,156,501.

The term hybridization refers to the process in which two single-stranded nucleic acids bind non-covalently to form a double-stranded nucleic acid; triple-stranded hybridization is also theoretically possible. Complementary sequences in the nucleic acids pair with each other to form a double helix. The resulting double-stranded nucleic acid is a "hybrid." Hybridization may be between, for example tow complementary or partially complementary sequences. The hybrid may have double-stranded regions and single stranded regions. The hybrid may be, for example, DNA:DNA, RNA:DNA or DNA:RNA. Hybrids may also be formed between modified nucleic acids. One or both of the nucleic acids may be immobilized on a solid support. Hybridization techniques may be used to detect and isolate specific sequences, measure homology, or define other characteristics of one or both strands.

The stability of a hybrid depends on a variety of factors including the length of complementarity, the presence of mismatches within the complementary region, the temperature and the concentration of salt in the reaction. Hybridizations are usually performed under stringent conditions, for example, at a salt concentration of no more than 1 M and a temperature of at least 25.degree. C. For example, conditions of 5.times.SSPE (750 mM NaCl, 50 mM NaPhosphate, 5 mM EDTA, pH 7.4) or 100 mM MES, 1 M Na, 20 mM EDTA, 0.01% Tween-20 and a temperature of 25-50.degree. C. are suitable for allele-specific probe hybridizations. In a particularly preferred embodiment, hybridizations are performed at 40-50.degree. C. Acetylated BSA and herring sperm DNA may be added to hybridization reactions.

The term "label" as used herein refers to a luminescent label, a light scattering label or a radioactive label. Fluorescent labels include, but are not limited to, the commercially available fluorescein phosphoramidites such as Fluoreprime (Pharmacia), Fluoredite (Millipore) and FAM (ABI). See U.S. Pat. No. 6,287,778.

The term "solid support," "support," and "substrate" as used herein are used interchangeably and refer to a material or group of materials having a rigid or semi-rigid surface or surfaces. In one embodiment, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 for exemplary substrates.

The term "target" as used herein refers to a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, oligonucleotides, nucleic acids, antibodies, cell membrane receptors, monoclonal antibodies and antisera reactive with specific antigenic determinants (such as on viruses, cells or other materials), drugs, peptides, cofactors, lectins, sugars, polysaccharides, cells, cellular membranes, and organelles. Targets are sometimes referred to in the art as anti-probes. As the term targets is used herein, no difference in meaning is intended.

A "probe target pair" is formed when two macromolecules have combined through molecular recognition to form a complex.

U.S. Pat. Nos. 5,800,992 and 6,040,138 describe methods for making arrays of nucleic acid probes that can be used to detect the presence of a nucleic acid containing a specific nucleotide sequence. Methods of forming high-density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling. For additional descriptions and methods relating to arrays see U.S. patent application Ser. Nos. 10/658,879, 60/417,190, 09/381,480, 60/409,396, 5,861,242, 6,027,880, 5,837,832, 6,723,503 and PCT Pub No 03/060526 each of which is incorporated herein by reference in its entirety.

EXPERIMENTAL EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Example 1

Identification of Markers Differently Expressed in Oocytes

The processing of oocytes was conducted in a dedicated DNA-free clean-room environment. A total of 27 oocytes, including seven single oocytes (three chromosomally normal and four chromosomally abnormal) and four pooled samples each consisting of five pooled oocytes of unknown chromosomal status were analyzed.

Oocytes were collected in sterile, RNase-free conditions and processed rapidly in order to minimize changes in marker expression. The zona pellucida was removed to ensure the exclusion of all cumulus cells from the sample and the polar body was separated from the oocyte. The oocyte was transferred to a microcentrifuge tube and then immediately frozen, while the polar body was thoroughly washed to remove any DNA contaminants before transfer to a separate microcentrifuge tube.

The polar body DNA was released by lysing the cell. Polar bodies were washed in four 10 uL droplets of phosphate-buffered saline—0.1% polyvinyl alcohol, transferred to a microfuge tube containing 2 uL of proteinase k (125 ug/mL) and 1 uL of sodium dodecyl sulfate (17 uM), and overlaid with oil. Incubation at 37° C. for 1 hour, followed by 15 minutes at 95° C., was done to release the DNA. (see Wells et al., 2002, Fertility and Sterility 78:543).

The polar body DNA was then amplified using a whole genome amplification method called degenerate oligonucleotide primed PCR (DOP-PCR). Polar-body DNA was amplified using a modification of previously reported methods (Wells et al. 1999, Nuc Acids Res 27:1214-1218). Amplification took place in a 50-uL reaction volume containing the following: 0.2 mM dNTPs; 2.0 uM degenerate oligonucleotide primer, CCGACTCGAGNNNNNNATGTGG; 1× SuperTaq Plus buffer, and 2.5 U of SuperTaq Plus polymerase (Ambion, Austin, Tex.). Thermal cycling conditions were as follows: 94° C. for 4.5 minutes; 8 cycles of 95° C. for 30 seconds, 30° C. for 1 minute, a 1° C./s ramp to 72° C., and 72° C. for 3 minutes; 35 cycles of 95° C. for 30 seconds, 56° C. for 1 minute, and 72° C. for 1.5 minutes; and finally, 72° C. for 8 minutes. After amplification was complete, a 5-uL aliquot of amplified DNA was transferred to a new PCR tube and retained for single-gene testing.

The amplified DNA was used for the purposes of comparative genomic hybridization (CGH), a method that reveals the copy number of every chromosome in the sample. The chromosomes within the polar body are a mirror image of those in the oocyte (e.g. if the polar body has one copy of chromosome 21 too few, the oocyte will have one copy of chromosome 21 too many). Thus, analysis of the polar body indicates whether or not the oocyte is abnormal. Amplified DNA samples (whole-genome amplification products) were precipitated and fluorescently labeled by nick translation. Polar-body DNA was labeled with Spectrum Green-dUTP (Vysis, Downers Grove, Ill.), whereas 46, XX (normal female) DNA was labeled with Spectrum Red-dUTP (Vysis). Both labeled DNAs were precipitated with 30 ug of Cot1 DNA. Precipitated DNA was resuspended in a hybridization mixture composed of 50% formamide; 2× saline sodium citrate [SSC; 20×SSC is 150 mM NaCl and 15 mM sodium citrate, pH 7]; and 10% dextran sulfate). Labeled DNA samples dissolved in hybridization mixture were denatured at 75° C. for 10 minutes, then allowed to cool at room temperature for 2 minutes, before being applied to denatured normal chromosome spreads as described below.

Metaphase spreads from a normal male (46, XY; Vysis) were dehydrated through an alcohol series (70%, 85%, and 100% ethanol for 3 minutes each) and air dried. The slides were then denatured in 70% formamide, 2×SSC at 75° C. for 5 minutes. After this incubation, the slides were put through an alcohol series at −20° C. and then dried. The labeled DNA probe was added to the slides, and a coverslip was placed over the hybridization area and sealed with rubber cement. Slides were then incubated in a humidified chamber at 37° C. for 25-30 hours. After hybridization, the slides were washed sequentially in 2×SSC (73° C.), 4×SSC (37° C.), 4×SSC+ 0.1% Triton-X (37° C.), 4×SSC (37° C.), and 2×SSC (room temperature); each wash lasted 5 minutes. The slides were then dipped in distilled water, passed through another alcohol series, dried, and finally mounted in anti-fade medium (DAPI II, Vysis) containing diamidophenylindole to counterstain the chromosomes and nuclei.

Fluorescent microscopic analysis allowed the amount of hybridized polar body (green) DNA to be compared with the amount of normal female (red) DNA along the length of each chromosome. Computer software (Applied Imaging, Santa Clara, Calif.) converted these data into a simple red-green ratio for each chromosome; deviations from a 1:1 ratio were indicative of loss or gain of chromosomal material. On the basis of this analysis, oocytes where identified as chromosomally normal or chromosomally abnormal.

RNA was extracted from those oocytes identified as chromosomally normal and from those identified as chromosomally abnormal. This was accomplished using an Absolutely RNA Nanoprep kit (Stratagene) according to the manufacturer's instructions. The RNA from normal and abnormal cells was amplified using a two round in vitro transcription procedure. For this purpose the extracted RNA was subjected to reverse transcription (RT), primed using an oligo(dT) primer containing a phage T7 RNA Polymerase promoter sequence at its 5'-end. First strand cDNA synthesis was catalyzed by SuperScript™ III Reverse Transcriptase (Invitrogen) and performed at an elevated temperature to reduce RNA secondary structure. The RNA of the cDNA:RNA hybrid produced during RT was digested into small RNA fragments using an RNase H enzyme. The RNA fragments primed second strand cDNA synthesis. The resulting double-stranded cDNA contained a T7 transcription promoter in an orientation that will generate anti-sense RNA (aRNA; also called cRNA) during a subsequent in vitro transcription reaction. High yields of aRNA were produced in a rapid in vitro transcription reaction that utilized a T7 RNA polymerase and the double-stranded cDNA produced in the previous step. The aRNA produced was then purified by spin column chromatography. This initial round of reverse transcription and in vitro RNA synthesis was undertaken using a TargetAmp kit (Epicentre Biotechnologies).

A second round of reverse transcription, second strand cDNA synthesis and in vitro transcription was accomplished using a NanoAmp RT-IVT labeling kit (Applied Biosystems), following the manufacturer's recommended protocol. During the second round of amplification labeled nucleotides were incorporated into the RNA, permitting subsequent chemiluminescent detection after hybridization to a microarray. The amplification process produced up to 21 ug of RNA per oocyte. The fragments produced were up to 10 kb in size (mean fragment size ~500 bp).

An Applied Biosystems Human Genome Survey Microrray was used to analyze RNA expression. This microarray has 32,878 probes for the interrogation of 29,098 genes. The chemiluminescent detection system of this microarray provides a great dynamic range that allows for the detection of rare transcripts and reliable identification of subtle variations in expression level. This microarray, and information about this particular microarray, is available from Applied Biosystems at: www2<dot>appliedbiosystems<dot>com. Expression analysis was performed using Panther software (Applied Biosystems, CA) and Spotfire.

Human oocytes were found to express over 12,400 markers. Of these, 6,226 markers appeared to be expressed consistently and have been detected in all samples assessed. A comparison of chromosomally normal oocytes with chromosomally abnormal oocytes revealed a total of 308 markers displaying a significant difference in expression level (46 markers p<0.01; 262 markers p<0.05). Of the markers displaying statistically significant differences in expression between chromosomally normal oocytes and chromosomally abnormal oocytes, those showing the greatest fold differences in expression are listed in FIGS. 1A, 1B, 1C, and 1D.

Several of the differentially expressed markers are known or suspected to be involved in the maintenance of accurate chromosome segregation, including checkpoint genes and microtubule motor proteins and may have fundamental roles in the genesis of aneuploidy in human oocytes. For example, abnormal expressed of TUBA1 was observed in aneuploid oocytes. Mutations in this gene destabilize spindle microtubules, potentially leading to chromosome malsegregation. Abnormal expression of dynein and kinesin genes (e.g. DNCL2B and KIF2B genes) was also observed and may be significant given the role of the protein products of such genes in facilitating chromosomal movement.

Although some of the pathways implicated have been suggested to be involved in the genesis of meiotic chromosome error, surprisingly, none of the specific differentially expressed markers identified have been the subject of investigation for meiotic chromosome error. For example, it has been speculated that mitochondrial dysfunction could lead to problems with chromosome segregation, possibly due to ATP depletion. However, the mitochondrial (or mitochondrion-related) genes highlighted in this study (e.g. MTCH2, HMGCS2) have not previously been suggested to have a role in aneuploidy.

The markers having traditionally attracted the most attention as potential candidates for regulating meiotic chromosome malsegregation, appear by this analysis to be of lesser importance. For example, well-characterized genes functioning in the metaphase-anaphase (spindle) checkpoint (e.g. BUB1 and MAD2) were not found to show altered expression in aneuploid oocytes, while lesser studied genes with potential roles in cell cycle control displayed significant differences in gene expression, such as ASP (abnormal spindle-like, microcephaly associated.) and UBE2V2.

Several markers involved in nucleoside metabolism and cholesterol biosynthesis were differentially expressed between chromosomally normal and chromosomally abnormal oocytes, including PRPSAP2 and CYP3A4. This suggests that these processes might be directly or indirectly involved with chromosome malsegregation during female meiosis.

Several markers are located on the cell surface, or are excreted proteins, or are involved in biosynthetic pathways that affect levels of excreted metabolites were differentially expressed between chromosomally normal and chromosomally abnormal oocytes. For example, genes for cell surface receptor proteins, TNFRSF21, PTPRM, ESRRA, GPR103 and THRA.

Example 2

Identification of Markers Differently Expressed in Cumulus Cells

The processing of cumulus cells was conducted in a dedicated DNA-free clean-room environment. A total of six cumulus cells (three chromosomally normal and three chromosomally abnormal) were analyzed.

Cumulus cells were collected in sterile, RNase-free conditions. The cumulus cells were separated from the oocyte mechanically and processed rapidly in order to minimize changes in marker expression. The zona pellucida was removed from the corresponding oocyte and the polar body was separated. The oocyte was transferred to a microcentrifuge tube and then immediately frozen, while the polar body was thoroughly washed to remove any DNA contaminants before transfer to a separate microcentrifuge tube.

The polar body DNA was released by lysing the cell. Polar bodies were washed in four 10 uL droplets of phosphate-buffered saline—0.1% polyvinyl alcohol, transferred to a microfuge tube containing 2 uL of proteinase k (125 ug/mL) and 1 uL of sodium dodecyl sulfate (17 uM), and overlaid with oil. Incubation at 37° C. for 1 hour, followed by 15 minutes at 95° C., was done to release the DNA. (see Wells et al., 2002, Fertility and Sterility 78:543).

The polar body DNA was then amplified using a whole genome amplification method called degenerate oligonucleotide primed PCR (DOP-PCR). Polar-body DNA was amplified using a modification of previously reported methods (Wells et al., 1999, Nuc Acids Res 27:1214-1218). Amplification took place in a 50-uL reaction volume containing the following: 0.2 mM dNTPs; 2.0 uM degenerate oligonucleotide primer, CCGACTCGAGNNNNNNATGTGG; 1× SuperTaq Plus buffer, and 2.5 U of SuperTaq Plus polymerase (Ambion, Austin, Tex.). Thermal cycling conditions were as follows: 94° C. for 4.5 minutes; 8 cycles of 95° C. for 30 seconds, 30° C. for 1 minute, a 1° C./s ramp to 72° C., and 72° C. for 3 minutes; 35 cycles of 95° C. for 30 seconds, 56° C. for 1 minute, and 72° C. for 1.5 minutes; and finally, 72° C. for 8 minutes. After amplification was complete, a 5-uL aliquot of amplified DNA was transferred to a new PCR tube and retained for single-gene testing.

The amplified DNA was used for the purposes of comparative genomic hybridization (CGH), a method that reveals the copy number of every chromosome in the sample. The chromosomes within the polar body are a mirror image of those in the oocyte (e.g. if the polar body has one copy of chromosome 21 too few, the oocyte will have one copy of chromosome 21 too many). Thus, analysis of the polar body indicates whether or not the oocyte is abnormal. Amplified DNA samples (whole-genome amplification products) were precipitated and fluorescently labeled by nick translation. Polar-body DNA was labeled with Spectrum Green-dUTP (Vysis, Downers Grove, Ill.), whereas 46, XX (normal female) DNA was labeled with Spectrum Red-dUTP (Vysis). Both labeled DNAs were precipitated with 30 ug of Cot1 DNA. Precipitated DNA was resuspended in a hybridization mixture composed of 50% formamide; 2× saline sodium citrate [SSC; 20×SSC is 150 mM NaCl and 15 mM sodium citrate, pH 7]; and 10% dextran sulfate). Labeled DNA samples dissolved in hybridization mixture were denatured at 75° C. for 10 minutes, then allowed to cool at room temperature for 2 minutes, before being applied to denatured normal chromosome spreads as described below.

Metaphase spreads from a normal male (46, XY; Vysis) were dehydrated through an alcohol series (70%, 85%, and 100% ethanol for 3 minutes each) and air dried. The slides were then denatured in 70% formamide, 2×SSC at 75° C. for 5 minutes. After this incubation, the slides were put through an alcohol series at −20° C. and then dried. The labeled DNA probe was added to the slides, and a coverslip was placed over the hybridization area and sealed with rubber cement. Slides were then incubated in a humidified chamber at 37° C. for 25-30 hours. After hybridization, the slides were washed sequentially in 2×SSC (73° C.), 4×SSC (37° C.), 4×SSC+ 0.1% Triton-X (37° C.), 4×SSC (37° C.), and 2×SSC (room temperature); each wash lasted 5 minutes. The slides were then dipped in distilled water, passed through another alcohol series, dried, and finally mounted in anti-fade medium (DAPI II, Vysis) containing diamidophenylindole to counterstain the chromosomes and nuclei.

Fluorescent microscopic analysis allowed the amount of hybridized polar body (green) DNA to be compared with the amount of normal female (red) DNA along the length of each chromosome. Computer software (Applied Imaging, Santa Clara, Calif.) converted these data into a simple red-green ratio for each chromosome; deviations from a 1:1 ratio were indicative of loss or gain of chromosomal material. On the basis of this analysis, oocytes and there associated cumulus cells where identified as chromosomally normal or chromosomally abnormal.

RNA was extracted from those cumulus cells associated with chromosomally normal oocytes and from those associated with oocytes that were chromosomally abnormal. This was accomplished using an Absolutely RNA Nanoprep kit (Stratagene) according to the manufacturer's instructions. The RNA was amplified using a two round in vitro transcription procedure. For this purpose the extracted RNA was subjected to reverse transcription (RT), primed using an oligo (dT) primer containing a phage T7 RNA Polymerase promoter sequence at its 5'-end. First strand cDNA synthesis was catalyzed by SuperScript™ III Reverse Transcriptase (Invitrogen) and performed at an elevated temperature to reduce RNA secondary structure. The RNA of the cDNA: RNA hybrid produced during RT was digested into small RNA fragments using an RNase H enzyme. The RNA fragments primed second strand cDNA synthesis. The resulting double-stranded cDNA contained a T7 transcription promoter in an orientation that will generate anti-sense RNA (aRNA; also called cRNA) during a subsequent in vitro transcription reaction. High yields of aRNA were produced in a rapid in vitro transcription reaction that utilized a T7 RNA polymerase and the double-stranded cDNA produced in the previous step. The aRNA produced was then purified by spin column chromatography. This initial round of reverse transcription and in vitro RNA synthesis was undertaken using a TargetAmp kit (Epicentre Biotechnologies).

A second round of reverse transcription, second strand cDNA synthesis and in vitro transcription was accomplished using a NanoAmp RT-IVT labeling kit (Applied Biosystems), following the manufacturer's recommended protocol. During the second round of amplification labeled nucleotides were incorporated into the RNA, permitting subsequent chemiluminescent detection after hybridization to a microarray. The amplification process produced up to 154 ug of RNA per cumulus cell. The fragments produced were up to 10 kb in size (mean fragment size ~500 bp).

An Applied Biosystems Human Genome Survey Microarray was used to analyze RNA expression. This microarray has 32,878 probes for the interrogation of 29,098 genes. The chemiluminescent detection system of this microarray provides a great dynamic range that allows for the detection of rare transcripts and reliable identification of subtle variations in expression level. This microarray, and information about this particular microarray, is available from Applied Biosystems at: www2<dot>appliedbiosystems<dot>com. Expression analysis was performed using Panther software (Applied Biosystems, CA) and Spotfire.

Human cumulus cells were found to express over 8,000 markers. Of these, 3,350 markers appeared to be expressed consistently and have been detected in all samples assessed. A comparison of chromosomally normal cumulus cells with chromosomally abnormal cumulus cells revealed 752 markers displaying a significant difference in expression level (125 markers p<0.01; 627 markers p<0.05).

Of the markers displaying statistically significant differences in expression between chromosomally normal cumulus cells and chromosomally abnormal cumulus cells, those with the greatest fold differences in expression are listed in FIGS. 2A, 2B, 2C and 2D.

The disclosures of each and every patent, patent application, and publication cited herein are hereby incorporated herein by reference in their entirety.

While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

SEQUENCE LISTING (380 sequences)

SEQ ID NO: 1 - DNA, 4689 bp, Homo sapiens
ccgcagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatgtagttattcctctggaccatgaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttaactcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtcttttaaaaaggcagtgctgtcttacctcttgctagtgggttaaatgttttcaaaaattatagcagtagtagaagttttgtataaaatttgtccttatttgttaattgtatataaatgttaattatttgatacgaatgttatgcatttagtatgcacattgaagtctaaactgtagaagagtctaaaacaagttctctttttgcagattcacatactaatggtttaattctgtgctctgtttaaagtactattataactagagtagatctgaatgaggataaccctaaaatcatgaggaatggaagaatggaccttgaaactacctaggcttttatgcatggcacctctttataatgaagacactttttaaagtttttgtttttgtttcaattaccgctagatttttttttctctttttttaaaatccattttactggaaagttggccagcagagggagtagaaattattaaaattctagtgtttggattgggcccttctctaacagtacatactcattcccaaagcaatccaaaaacaaaatgtgaaccatttgggtttcaaatgttaagaacactaaatagcatgatttaaaaaatgaaaaatgctaacacccaagaaaagaagatattaagtgctttttaacaactcctagagtacaaaatgagtacatcataatgctggctcttctactaatgaaccatcgagtgatattgaataaattatttatcttctcagtttccttatctgtaaattacaatattagactaagtaagtttttccaactcttcactaccaattaccttaggcttttataatgctccgcctacttcagtcccatgtttcagaagcttttgtctattttttaaactcattgattaaataatgattaatgcattctccacattttaatattgcaaaggcccattggagtttctgaagtggctccacagaattgaaataatttcaaataactgtaaaggaactgaaaatcttcacagagatgaagtggggtttccattaggtgctttgaaatttgataacaaatcatcaacttccactggtcaatatatagattttgggtgtctgaggccccaagattagatgccactaatctccaaagattccctccaattatgaaatattttaatgtctacttttagagagcactagccagtatatgaccatgtgattaatttcttttcacactagataaaattacctggttcaaaagtggtttttgtttattaaatttggtaataaatatatataatacacagacaggatagtttttatgctgaagtttttggccagctttagtttgaggactccttgataagcttgctaaactttcagagtgccctgagacacttccagccatccctcctcctgccttcattggggcagacttgcattgcagtctgacagtaattttttttctgattgagaattatgtaaattcagtacaatgtcagtttttaaaagtcaaagttagatcaagagaatatttcagagttttggtttacacatcaagaaacagacacacatacctaggaaagatttacacaatagataatcatcttaatgtgaaagatatttgaagtattaattttaatatattaaatatgatttctgttatagtcttctgtatggaattttgtcacttaagatgagctgcaaataaataataccttcaatgg

SEQ ID NO: 2 - DNA, 2699 bp, Homo sapiens
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggt

SEQ ID NO: 3 - DNA, 630 bp, Homo sapiens
ggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtattt

SEQ ID NO: 4 - DNA, 3111 bp, Homo sapiens
acttatagaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaatactgtgtccaaccattgctgaatccaggagatgcaagatgacaatgaggcattgtccaggagggaagagaacaccaaaggcgaaggagaagaggaacaagaaaaagaaaaggaagctgatagaaagggcccaggagcaacacagcgtcttcctagctacagacagagctaaccaataaaacaagagatccggtagatttttaggggtttttgtttttgcaaatgtgcacaaagctactctccactcctgcacactggtgtgcagcctttgtgctgctctgcccagtatctgttcccagtaacatggtgaaaggaagcaccaccagcatggcccctgtgttatttatgctttgatttgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatttatgctttcttgtgggtaacaagtcatacctgattaatatgatgccactttgtttctagtggttcctaacccattgtctgataaatgacttttctagtttggggaattgacacttgttttgttgcctcttgaaactttttttttttcccctcattgtgggcttatttctcattgtaagggtaggataaactagtttttgtatatagagtcaaatgaccagtgtcaaagagtttgcatattgggtagaccttctccactccacatgtcccacacatatagataaagcagcaggcggcatctggcaatcagaagcccaaactgcctttgagtctaagatgtgatgactttgatgaaacacaactgaaaacatgagggactatatccagtcacttgtagccagtttcacaggccagctacagaattgtccaaacaaacattatttctgactgcaatttttttcccccaaatttaaagcaatccctggctttaaatgacaaggcacctaccaatgttcttgggtcactgaagaagctactaccatgagcctgggcatagaattttaggagataaaaggatgaatttctgtgactgccagtcagatcttaacaggtttctgttgagccagaatctgtttcagatccaagatggagaggaacactatggaaacttcccaggtgactttcagagcagttgtttcaaacacatcattgtccttttaggggaaccagtttttagaaggttgtgaattggctttttcacaaagcatgattatcttcctggctgatccaggagaaaattagaacagaaaaataatggttgtggattttgaaacaaagcaaggtaaagccttttttttttcaccttgcattggcaaaactacctcttcagtgtttttaacttttgattcaaaagcatcttaccaataaggataaatatcatatacatcgttatgaaaatattgctatgagataataagccacatatgaatgttgtatacaactttagggtttacatttaatcctgaagtgttacctcctttcatgtctatttacactattttcccatttactaagtggggagggggtctccttatatagtgcttcatcgttaataagtcaatacctgttgttcctgggatgttcttttttgtgcattaaaaacttcaaaatt

SEQ ID NO: 5 - DNA, 4424 bp, Homo sapiens
cccgcctcccagtagccgcgcctcaccctaggccaggaatggttttagggaagactgttgccggatgacaaggctgtcactattgttctgtactacctgacattatgggaccaggccagccagcttcaacctgtgttcatctagcacctaggacccaacttgatgggaggagcgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagatagactagaagaagctttggatccagatgaagaacgtcgaatccgtatcaggagacaggagcaagctgctcgctctgcccgaatgctctacgtcctccagcagcaggtaaaagaaatccaggaagaattggataaattgagtccacataaaattaaacacactaagaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgccgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacagggtgtttaacctggggagttaaatgtgtacacttgaattaataggagcaccggttgttgctagtataaagtaatttgtgtggcagtttgtactgtgctgagtttttaaaataaacccaatatttt

SEQ ID NO: 6 - DNA, 4630 bp, Homo sapiens
ggagcccgtgcgcggcccgggcagccgcgctttcccaaaaaacacaccttgactttagtcagatacatcactgtctgttaaaggaaaccaagcgtgaagtggaagtctaacacatgaggatacagaattgattcaaaatgggaacaacaagtgatgagatggtgtctgtggaacagacctcctcctcttctctaaaccccctgtgttttgaatgtggccaacagcactggacaagagaaaaccatttgtacaattaccagaatgaagtggatgatgacctagtctgccatatttgccttcaacctctgctgcagccactagacacaccctgtggacatacattctgctacaagtgcctcagaaactttttacaagagaaagatttctgtccgttggaccggaaaagacttcattttaagttgtgcaagaagtctagtattctagttcataaactcctagacaaattattagttttatgtccattttcttcagtgtgcaaagatgtaatgcaacgttgtgatctggaggcacatctcaaaaacagatgtcctggagcttctcatcggagagttgccctggagagaaggaaaactagtagaactcaagcagagattgagaatgaaaatgggcccactctactagatcctgcaggtaccttatctccagaagcagactgtttggggacaggcgcagtgcctgtggagcggcacttgacatcagcgtctctttccacatggagtgaggagcctggccttgacaaccctgcctttgaggagagcgctggagctgacaccacacaacagccacttagtttaccagaaggagaaatcaccacgattgaaattcatcggtccaatccttacattcagttaggaatcagcattgtgggtggcaacgaaacacctttgattaacattgtcatccaggaggtctatcgggatggggtcattgccagagacgggagacttcttgctggagaccagattcttcaggtcaacaactacaatatcagcaatgtgtcccataactatgcccgagctgtcctttcccagccctgcaacacactgcatcttactgtgcttcgagagaggcgctttggcaaccgagcacacaaccattctgatagtaactctccacgagaagagattttccaagtggctcttcataaacgggactctggtgaacagcttggcattaaattggtgcgaaggacagatgagccaggggtttttattcttgacctgttggaaggggggttggctgcccaggacggcaggctaagcagcaatgaccgagtgctggccatcaatgggcacgacctgaagtatggaactccggagcttgctgcccagattattcaggccagtggagagagagtgaatttaacaattgctagaccagggaaaccccagcctggtaacaccattagagaagcaggaaatcatagcagcagcagccagcaccacacaccaccaccgtattatagcagaccaagctcacataaggatcttactcagtgtgttacatgccaagaaaaacacattactgtaaagaaggaaccacatgaatcccttggcatgaccgttgctgggggcaggggaagtaagagtggtgagctgcccatctttgtgaccagtgtgccaccccatggctgccttgcacgagatggcagaataaagagaggtgatgtgttgctaaatatcaacggcattgatttgaccaatttaagtcacagtgaggcagttgcaatgctgaaagccagtgccgcgtcccctgctgttgcccttaaagcacttgaggtccagattgttgaggaggcgactcagaacgcggaggagcagccgagtactttcagcgaaaatgagtatgatgccagttggtccccatcatgggtcatgtggcttgggcttcccagcacacttcatagctgccacgatatagttttacgaagaagttacttgggaagttggggctttagtatcgttggtggatatgaagagaaccacaccaatcagccttttttcattaaaactattgtcttgggaactcctgcttattatgatggaagattaaagtgtggtgacatgattgtggccgtaaatgggctgtcaaccgtgggcatgagccactctgcactagttcccatgttgaaggagcagaggaacaaagtcactctgaccgttatttgttggcctggcagccttgtatagattttggaaattggtttcaaatcttgcatcttccttttttagatttttgaaagaaaaccctttggtttcattgtgtttgtggtttaggagctgctgacactgctggtatacacagggccaaaacccactaagattgtccgtttatgtttatttaaatggtttcctaagttagttacatttcttttagcttggaaacagtcttccactaacctttgtgagtttatattttcagaattcagacttagttgttaaaatgttacctatggtaatgagcaaagctcacccaaactgtgccccagatggagtaaagaccttctggtgggtctttgttttcagtaactgaatcatagaacgagttctgtatccctcaggcctgatgtcagcaaagccagtaacaacagcgtgtactgccactgtcataaccaataccatgaatgaatatactttaaattttggtgataactgttccccatttttttttgaaccacagtctcactctcacccaggctggagtgcagtggcacaatctcagctcactgcaagctccgcctcctgggttcacgccattctcccacctcagcctcccgagtagctgggactacaggcgtgtgccaccatgcccagctaattttttgtacttttagtagagacggggtttcaccgtgttagccaggatggtctcgatctcctgaccttgtgatctgcccgcctcagcctcccaaagtgctgggattacaggtgtgagctgccgcacccggccgttcccattttttattggtgccaacatttcaaaacttcatactgtttataaactgattttctggtttatttctactgtaatctctcaatattcatagaagatgaagaaataagtctgacaacactaaagaaatttcttaatatactattattagaatagtagaggataaaagataatgttatccagttacaaaggaatttggatgataattataacttaatgttagagatggtaaagctgcacttacttgaacagcccaaaagcattaaaaatctatttccagaggaatgttttgctatgtagggaaattttgaagtagtttttgctaaaaaattatttctagagttgtgttattcttagcagtaatcttggctagaaatgtttttgtgatttatgcgattaaacgaaatgataaagataaaaccatattattaaatacctatatatcacagctaagtaggagaaagggagacctttttattttgttcaggtaggagtatttcttgtgtattttagaaacaattatttttcccattatttcttatgagattagttgtttcaagtaggagacagaaaagttctgttttgttggaaatgtaggttttagatgtatctttcagtcagctctcagtcactagactatttcatattttttgaaatgtttttgaaaattatgactagcccattttttgtcctttattcaacatacttatcctctgaacacataaataagtgaataagataaaaatatctttaccttattaatattatacatacttgaaaaaaatttcatttagaaacctagttcagaatctgagcaaatttacaagtgacctctgtaataaatggtattgataatcagagaatgtatttcagaatactacagtacaatatattatgaagcatgaccactttattttgaaacttagcaattgtattgctggggtttattgtatctgtagcatgtcactgattatttcagttagttttataatgatttttaaaaaacatatctatttggaataagatacagcaacaatcattgctactgacttgttcaaccccttagttacactgtatgatcaacatataacaagatacagtggaatggcccatacagtatattactgttgtgtgatgattggctttggaagcagtttgattttgaaatgctttgatattctaattgacatggaacaagttttttccctgctccccaaatagaattttgtaaccaactttgctatttttttaaagtttgtaagaatgtgtcatttcttggggagtagccatccatcaacaaatatcctgactgctactttgttatatacaaaatacttacattgaacctggtggcataatgagtattttgaaagaagaaatttcttcactctcatttttatagaaatcttggaatcagcttaagctgtagcttttatgacaaaagacagtcatttttggtcagagtgatatttggtgacggaaacttgttcataatttattgttactatagaactatttggattttctcatttttagttctgatagttaaatattttggtttgttctgtgccttcagtttaaattatttcaggatttttcagatgtttaaataatggtgtgaatcattcaggatggaaataaaagtcatcctttctgt

SEQ ID NO: 7 - DNA, 4410 bp, Homo sapiens
cattaggaatcagtggtattgttatagtctaccaggaccgacctggtgctgctcagaaccaggggctcaaggcagggcctcccttcatcttcttaaattattctctagcagctctgagtctcccaaagattggtcctagagaaaagactatgtcatttactgctttttctgatggtaaaaacatgcatatttactgcagaaaatttgaaaaatagagaaatgtgtaaagaagaaaacgtacaaaataactttagactcaaaaccaatctgattaaatcaggaaatcattatttattgagcacctactatgtgccagccactgttgttcttggtgctggggacatagcagtgaaaaaaaaacaaagtcctccccttcgtggagcctatatttcagtagggacagtcagtacagtacaggaaggggctgggctgatggaacaggatgccttttttgatagggtggtcaggacaagaggaagcaagggatgcagctatttggggaagagtgtttccagcagaaggaagaagacctgcccaggtgtcggataagagcctgcttggtgcattcagggatacgaaggaggccagcgtggctgagatgaggtaggggcagccggggtgagaacaggtgggacttgccggccatgaagaggaccttggattgctgttgagtgaaatggaaagccaaatgtagggtcttgaacagaagagggacatgatgagccttatgttttgaaatgatcattctggacaccagatggaaaatagacaggggctgggggtggggttggcaaggggagaagcttggaagccatttggttattgcgaaagtcacacaaagctgtgaaagcagagctggcctggttgaaggaagggtggaggtggggggagggccggcatttcctcccactgagcctctgcccttcccttttcctgctctctgaggttccaccatgggaccccagggtacctaggattacaatttgaaagctattggactagaggttctctaagggcccttccagctttgcctcctgtgctcttgtgtttcaggaccatgctgattctgtgggaccaggcccgggctctaccagccaggcctctgaacatgtcaacttgagaactgaacaggttcagggtctaggaaggggagacatttcaaaattttaattaaaaaatatttttaacgtttaaatttttgtagagacggggtcttcccatgttgcccaggctggtctcaaatttctgggctcgggtgatcctcccgccttggcctcccaaaatattgggattacagacatgagccatgagatttggaaacttaattcagctcccacatactaaacgtggccagccctgtgtggggattgtaagaggggataagtaagaggaaatgtctgctccaagaaactcactggctgggatgggaactagggaatcacacaaatggcccagcccaaagtctgagaggccccggcccctccctgcctggccttttttccatgtggcccctgagccagtggttcccaaactgggcaggtcatggggtcatcgaggaacttcagaatatgcagatgcccagactgtgccctcaaagattcaaattcagttagtcgagggtgggtggggcctgggaatctgttcagacaaaggcctggcctgaagcctgggctggagggttcagtccagacagaagaacagagactgatgagagggcttctgccagcttcaccaagcccgtgctaggcaggatgtggaaatcaagcctgtcttccagtggggcacgggggtggggagctggaggagggggtggcagctcctttatcagctgtccccatcagaggcccttctcccaggaaggaatgtttaaaaaactcccaggaaggaattgctgggtttggagactatgagaattccccatctcccccaatctcctcagccacctcaaatcaaccagcccgtctccccatgtttgggttaactccttattggctcggaatgtctcgcctgggttgactactgatctgtgagatcgcttagtggcctgaaatatttccagaatacaagcaacactgacaaaaatattcttgtagggccccacaaatctcactgagaaagaacccctacaggtggagaggagtgtggggtatgcagactggaaggtgggaccctgattcattccagaactggaaggaaatcagacatttccaaacaggagagagatgggaagccggaggaaggagcaggaggagggaagagaatgaatcttatgtgaatgaatggtaattttctctcagttactgggaagaaaaaaaaataacaaaatcagaccttggtctggtccactaaaaagaattctctgagtcagacttctttcatggaagttgtgaactttatcctctggcagccatttatctaatattaaaccccttaaccttcctaattgttctctttcagtatcagctggtttcatattaacctttcagtctttcccataatgcagttacctccaactcccgccagacccaattcagagctgccatcaggtcagacctttgcctgctcttggcaacacgtccccctgtcctgctcctctgcaacctgcccctctttttcttcatgtgctgtgaaggcaccatgtggatgggtgttcaacttctggattggggatgcacagagcctgagggacacactttgcaaacctgcaccttgcacttttgggttctggcctgcaaggtctcctttattcttttggaccaaggctgtccctgggagagggcagccgccggcctgtcagagcaaatcagcctcaggcggtttctgcggctctggtatttgagctttgttttccctctctcccgggaagaactcattgaaatagtttctctgggaaagacaaagcgtctcgcccagatgctgaaggatcacttggtaactgcctgtcttggtttcccgttgtgcccatgaaggcgccatcagctctaaagctgacctgtggttccgtctccaaacagctaacccagacgtcacccccttgcagccagccgcacagcctgagttggagttctggcctctcctagcagtgagtgacagtgttggaggggccttggacaccttgggtaattgctaactaaatatgagcagtaggggaaggtcttctggtccacggcagagccaacggggcacttcctcttctcttttctagtcagggtagaaagctagaaagaatcctaaaaatcactatccaagtccccattgtgtggggacagaggcctggcctgaagcctaggctggagggttcagtcggaagcagaagccgggagactgcatgagagggttccttccagcttcaccaagcccgtgctgcgcgggatgaagaaagtcaagcctgtcttccagtggggccctgaggtgggggagctggaggatagggtggcagcttttttatcagctgtccccaaaagaggcccttctcccagttgccacggaccaaagctcctcctgggagctccagcctgtctgttcaatgtttgccttgcgccttttcctggtgaggccacccccggcaccatctcaggcctcagaaggacgacctcactgaaacagcccttaggttgggaaagaagcaagccctccgcgccccgtccaagtctctcaactgggcacgagcacacacagacgcccaggccctgtccctgcgccagaatggccgctcgcgtttccaggcacgatgcccctttccatgagtgcacagagccctgggctgagctgggggccgagctccacgctctctgagcagctctgagcggcacgccaaagaaggtctttcagatgggctctgggatgtggaaccatggcgtccagccctagcgtcgactccacactagaggcaccctgactttcgcccccttcttacctgagtatcagcttacttccatctggggactgaatatggggcagattccagaaaaaggaggttggggcaccaaaaccaacaccaactctgccaacggagccagcacagctatttgtctccaaccacaggccgcaagggaagttcacgggctcggcacccccaggtcccggatgtaaggatattgcccgttagacaaaggaaaggccccaagtccacaactcatgtttgtgagcttaaccttgtcctataaagcactttggaacaggcccaggttctcccaccatgtacagctgccattgacctggacagtcccgcaaggtccttcagtggaaacccagaagggagagtcactgcatgtgaaccctaagggttctggaggtcaaagttgctgtgggtgacaggcaaccaagactaagggcaaacttgaaacataaatgagttaaaacccacaaaaataagacagttttaaataactaaaaaaaaaaaaaaaaaaa

SEQ ID NO: 8 - DNA, 1256 bp, Homo sapiens
attcctgcgctggaggccgcctctgacgccaccggctgggctccgccatgagttcggcgccggcctcaggctccgtgcgcgcgcgctatcttgtgtacttccagtacgtgggcaccgactttaacggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctgg

SEQ ID NO: 9 - DNA, 1578 bp, Homo sapiens
cgctcgcgcccggatccctcaggggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggccggctgtggacccccgcggcctggggcaacccttcctggtgcccgtgcccgcccggccgcctctgaccaggggccagttcgaggaggcccgggcccactggcccacgtccttccacgaggacaagcaggtgaccagcgccctggctgggcggctcttctccacgcaggagcgcgccgccatgcagagccacatggagcgggcggtgtgggcggcccggcgggcagcagcgcggggcttgcgggccgtgggggccgtggtagtggacccggcctcggaccgcgtgctggccaccggccacgactgcagctgcgcggacaaccccctcctgcacgccgtcatggtgtgcgtggacctcgtggcgcgcggccagggccgcggcacctacgacttcagacccttccccgcctgctccttcgccccggccgctgccccccaggccgtccgcgcaggcgccgtgcgtaaactggacgcagacgaggacggcctcccctacctgtgcactggctacgacctgtacgtgacccgcgagccctgcgccatgtgcgccatggccctggtgcacgcacgcatcctgcgcgtcttctacggtgcgccctcgcccgacggcgccctgggcacccgcttccgcatccacgcacggcccgacctcaaccaccgcttccaggtgttccgcggggtgctggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaacc

SEQ ID NO: 10 - DNA, 1074 bp, Homo sapiens
cgccgtccacaccccagcggccctgacgctgtcccctccgcgaccctcgcctctggaaaaagtgacaggcaaggccacgcccccgcgagggccggcctggagcccgcagcccccagggcctgggacgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaaca

SEQ ID NO: 11 - DNA, 2294 bp, Homo sapiens
agttaggtcatgaggctttggccttgacaccaagggatgctgtctccttgccggaagcagctcaccaaagccggcagagaacccaggttccgtggggccacgatgtggggctccgcgggcgccccggcgctggccgacttcctgtctcctgggtcagatgctgctccgcactgcagctatggtcgcatgcagtgcctgccgaagcccgcagcaggaatgctgccttcggtgattttaatttcacttttctacttctctcaataacaaaatccgcgtttcaaactccagggaaaagaaaacggaattggctccaggaggatctgcaatcaccaccgggaactttgggaggctgggaagatggagccaaaccaatgtgtggggtggaggtgcggatctggggcggccggcctctcctacaggtctcaggtccgcaggcctggcgtgccagcacctgccacgggactggaagcccattccttgacaacgcctaaggggatcccgttgctagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgc

SEQ ID NO: 12 - DNA, 2260 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatca

SEQ ID NO: 13 - DNA, 730 bp, Homo sapiens
gccgccccgcgagaagaagagcgggaagaggcggacagcgaggccaagatttcagctgcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagatgcgtggtgcctccaggaccgctgcgggtggtaaccagtggaagaccccagcccccagggagaggaacccgttctatccccagccatgataataaagctgctctccca

SEQ ID NO: 14 - DNA, 2860 bp, Homo sapiens
gaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaat

SEQ ID NO: 15 - DNA, 1878 bp, Homo sapiens
atttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttact

SEQ ID NO: 16 - DNA, 3715 bp, Homo sapiens
attaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttattta

SEQ ID NO: 17 - DNA, 5470 bp, Homo sapiens
gcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 18 - DNA, 1948 bp, Homo sapiens
ctacttcattctacggccgagaccggaggatgttccctgctcaggaggaggccgacaggaccgtgtttgttgggaatttagaggcccgagttcgggaagagattctgtacgagctgttccttcaggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttggtagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgttcaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcatattgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatgttttt

SEQ ID NO: 19 - DNA, 2312 bp, Homo sapiens
ggcgcgctaggctcacaaaggcaggcacagactgcaaccctgctcagtgctccgggcgcttcaggctggcttgggtcctgctgctccaaccccaagggccctggagcgctccctgatacctccatcactcaccatggccagccagttctgcctccctgaatccccatgtctctcgcccctgaaacccttgaagccacatttcggagacatccaagagggcatctacgtggcgatccagcgcagtgacaagcggatccacctcgctgtggtcacggagatcaacagagaaaactattgggtcacggtagagtgggtggagaaagcagtcaaaaaaggcaagaagattgacctggagaccatactcctgctgaatccagctctggactctgctgaacaccccatgccgcccccgcccttatcccccttggctctggcgccctcttcggccatcagggaccagcgtaccgccacgaaatgggttgcgatgatcccccagaaaaaccaaacagcctcaggggacagcctggatgtgagggtccccagcaaaccttgtctgatgaagcagaaaaagtctccctgcctctgggaaatccagaaactgcaggagcagcgggaaaagcgcaggcggctgcagcaggagatccgagctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaaccttaaaggacctggatatcatcaccgtcccctcggacaatgtggttatggtgcatgagtccaagcaaaaggtggacctcactcgctacctgcagaaccagaccttctgcttcgaccatgccttcgatgacaaagcctccaacgagttggtgtaccagttcaccgcccagccactggtggagtccatcttccgcaagggcatggccacctgctttgcctatgggcagacgggaagtgggaagacgtacaccatgggtggagacttttcaggaacggcccaagattgttctaagggcatttatgctctggtggcacaggatgtctttctcctgctcagaaactccacatatgagaagctggacctcaaagtctatgggacattttttgagatttatgggggcaaggtgtatgatttgttgaactggaagaagaagctgcaagtccttgaggatggcaatcagcaaatccaagtggtcgggctgcaggagaaagaggtgtgttgtgtggaggaagtgctgaacctggtggaaatagggaatagctgtcggacttccaggcaaacacctgtcaacgctcactcatccaggagccatgcagtgttccagatcatcctgaagtcaggacggataatgcatggcaagttttccctcgttgatttagctgggaatgaaagaggagcagatacaaccaaggccagccggaaaaggcagctggaaggggcagagattaacaagagtcttctagccctcaaagaatgtattctggctttgggtcagaacaagcctcacaccccattcagagccagcaaactcacactggtgctccgggactcctttataggccagaactcctccacttgcatgattgctaccatctctccggggatgacctcttgtgaaaacactctcaacactttaagatatgcaaacagagtaaaaaaattaaatgtagatgtaaggccctaccatcgtggccactatccgattggacatgaggcaccaaggatgttaaaaagtcacatcggaaattcagaaatgtcccttcagagggatgaatttattaaaataccttatgtacagagtgaggagcagaaagagattgaagaggttgaaacattacccactctgttagggaaggataccacaatttcagggaagggatctagccaatggctggaaaacatccaggagagagctggtggagtacaccatgatattgatttttgcattgcccggtctttgtccattttggagcagaaaattgatgctctgaccgagatccaaaagaaactgaaattattactagctgacctccacgtgaagagcaaggtagagtgaagccaatggcgagagatcaggtccgaaatgctgcattgctgcagtttccaccactcttatacaggaaaactgtccaaattatctaaagatcctcctgagaagcttaaaacatcttaaaatacactgatgggaaacatgctctttcttctgcctctgt

SEQ ID NO: 20 - DNA, 5357 bp, Homo sapiens
ggcggccaggtggaggacctgagcaagcagctcaagcgtgtggacggccaggtgcagggcatcgccacgcacgtgcagcacttctcccaggccagcgggcttgacctggccgcgctagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcgggctcagaaacacttatgggattttctaagcacggagggttcacttccttaacatcacctgaagggactctaagcggagactctaccaagcaaccaagtattgagcaggctctggattctgccagtggtcttggcccggatcggactgcatcaggatctggtggcacagcacacccctctgatggggtttccagtagggaacaaagcaaggtcccctctggtactgggagacagcagcagccgagggcccgtgatgaagctggcgtgccacgactccatcagtcttctacattccaattcaaatcagactcagatcgtcacaggagtagagagaagcttacctcgacacaaccaagaagaaatgcacgtcctggtccagttcaacaggacttacccttggccagagaccagcccagtagtgtgcccgctagccagagtcaggtccatctaaggccagatcgtcgtgggttagaaccaactggcatgaatcagcctggattagtgcctgctagcacttacccacatggtgtggtacccctcagcatgggtcagcttggtgtgccaccacctgaaatggatgatcgggaattgataccatttgtcgtggatgagcaacgtatgttgccaccatcagtacctggcagagaccagcaaggattggaactacctagcacagaccaacatggtctggtttcagtcagtgcatatcagcatggtatgacatttcctggcacagaccaacgcagtatggaaccacttggcatggatcagcgtggatgtgtaatatcaggcatgggtcagcaaggactagtaccccctggtatagaccagcaaggattgacattgcctgtcgtcgatcaacatggcctggttctaccttttacagaccagcatggtttggtatcacctggtttgatgccaattagtgcagatcagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggcagatccacatggcctggtacaacctggtgcctatcctcttggtttggtacaacctggtgcatatttgcatgatttatctcaatctgggacatatccacgtggtctggtgcagccaggaatggatcagtatggtttgagacaacctggtgcatatcagccaggcttgatagcaccaggcacaaagcttcgtggctcttcaacattccaggcagattctacaggttttatatcagtacgtccatatcaacatggtatggtacctcctggcagagaacaatacggccaggtgtcaccactcctagccagtcaaggtttggcatcacctggtatagatcgaaggagtttggtaccaccagaaacttatcagcaaggtttgatgcatcctggcacagaccagcacagcccaataccactgagtacaggtttgggatctacacacccagatcaacagcatgtggcatcacctggcccaggtgagcatgaccaggtatacccagatgcagctcagcatggccatgctttctctctctttgacagtcatgattcaatgtatcctggttatcgtggcccagggtatctaagtgctgatcagcatggccaggaaggtttggatccaaatagaacacgagcctcggaccgacatggaattcctgcccagaaggccccaggccaagatgtcactcttttcaggagtccagactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatggtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaagctggaccgcctggagctggacccagtgaagcagttgctggaggatcggtggaaatcgctgcgacagcagctcagggagcgccccccactctaccaggcagacgaggcggctgccatgcggaggcagctcctggcacatttccactgcctctcatgtgaccggcccttggagacacctgtgactggacatgccatccccgtgacccccgcgggtccaggcctacctgggcaccattccatccgcccctacacggtgtttgaactggagcaggtccggcagcatagccgcaacctcaagctgggcagcgccttccctcggggtgacctggcgcagatggagcagagcgtggggcgcctgcgctccatgcactccaagatgctgatgaacattgagaaggtgcagatccacttcgggggctccaccaaggccagcagccagataatccgcgagctgctgcacgcccagtgcctgggctccccctgctacaaacgggtgacagatatggctgattacacctactcaactgtgccccggcgctgcgggggcagccacaccctcacctacccctaccaccgcagccgcccgcagcaccttccccggggcctgtatcctactgaagagatccagattgccatgaagcatgatgaggtggacatcttgggcctggatggccacatttacaagggacggatggacacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggagg

SEQ ID NO: 21 - DNA, 1787 bp, Homo sapiens
agcagctggaggttatcgaaaatctgttgtaaggagcattgttaacttagaataaaaatcgaatccaaaacacgcttttgcaataccccctcccgatatccaccgaggcaaaggcagaattaagaagcagggtcttgagatgtaggaaaggagaatgaaccccacgcgggaagaggacaggccgccctgactttggtccactcagccagggggtgagcaccacctgtcttggtgaatgactctgagcccatctcaggtgtggctgcaggtgacacatcttctcttcctgtccaccccccagccccatggcgtcccttcctgtcctgcagaaggagagcgtgttccagtcgggagcccatgcctacagaatccctgccctgctctacctgcctgggcagcagtccctgctggccttcgcggaacagcgggcaagcaagaaggatgagcacgcagagctgattgtcctgcgcagaggagactacgacgcacccacccaccaggttcagtggcaagctcaggaggtggtggcccaggcccggctggatggccaccggtccatgaacccatgccccttgtatgacgcgcagacggggaccctcttcctcttcttcattgccatccctgggcaagtcacggagcaacagcagctgcagaccagggccaatgtgacgcggctgtgccaagtcaccagcactgaccacgggaggacctggagctcccccagagacctcactgatgcggccatcggcccagcctaccgggagtggtccacctttgcagtgggcccggggcattgtttgcagcttcacgacagggcccggagcctggtggtgcccgcctacgcctaccggaaacttcaccccatccaaaggccgatcccctctgccttctgcttcctcagccatgaccatgggcgcacgtgggcgcgagggcactttgtggcccaggacaccctggagtgccaggtggccgaagtcgagactggggagcagagggtggtgaccctcaacgcgagaagccacctccgagccagggtccaggcccagagcaccaatgacgggcttgatttccaggagtctcagctggtgaagaagctggtggagccgccgccccagggctgccaggggagcgtcatcagcttccccagcccccgctcggggcctggctccccagcccagtggctgctctacactcaccccacacactcctggcagagggccgacctgggtgcctacctcaacccgcgacctccagcccctgaggcctggtcagagccggtactgctggccaagggcagctgtgcctactcagacctccagagcatgggcaccggccctgatgggtcccccttgtttgggtgtctgtacgaagccaatgattacgaggagattgtctttctcatgttcaccctgaagcaagccttcccagctgagtacctgcctcagtgagcctgtggtgcccacctcaagggcctgcctttcacctgcacacccagctcggaggctctgcggctgcctctccttcccgtggcccctggacgtgggggccactctgggctcccttcggcgcccgtgtgtggagagaggtgcacctcttgctcttttcctcctgcgtggttccagtcttcccaaaaggttctattttcagcccagaaaccaaaagtgtctggcttcccatagcccctccatagggaaggcgtggagggtcctgcagcgcagctgtcaccttgtctgcctgtcccctacccccagctttgtgtaggtcttgacaaatttctagttcaactc

SEQ ID NO: 22 - DNA, 2256 bp, Homo sapiens
cacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatg

SEQ ID NO: 23 - DNA, 495 bp, Homo sapiens
cagccctgacgcttccgtggggccacttccttttttgtctcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcaatct

SEQ ID NO: 24 - DNA, 3894 bp, Homo sapiens
cccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgccccttccctcccctaccccttatgttccctgtagctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccggaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcatttgccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctggtacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaatta

SEQ ID NO: 25 - DNA, 1506 bp, Homo sapiens
agcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagagggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataaggaataaaggaatttctaacatg

SEQ ID NO: 26 - DNA, 2395 bp, Homo sapiens
agagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctggg

SEQ ID NO: 27 - DNA, 902 bp, Homo sapiens
gatttactgaacatggctgctgaaatgtataacattattgtgcattattgctaccgtgatatgcggatttatattgcaattgcctctggattcagaaaaacacccttcacagtgaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctgtaagtatatttttgtagttatttctaattgttctcaccattcatttttcccttctgtcttaagtgctggtactaatgtgtagtgtgttctctttacattctccaagtacctgcctgaaacagtagctaatagctttggataacaatatatctttccttctctatgactagaagaaaaggactccttaataacaaagtctcacacttacttgctctgttaaatgtgtgctttattaaagcacaagaaggtttagtttataaaggttcatctttaaccaaaattttgtcggccaaaataaagctaataatgtgttaaac

SEQ ID NO: 28 - DNA, 3859 bp, Homo sapiens
ggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaagataaataagaaaaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtc

SEQ ID NO: 29 - DNA, 2765 bp, Homo sapiens
taaaagctgcttcctgttggggcatgagtccggcgcgtgtcgggttttgagctgccgcggtcccgggactgagctccttgggagcagacagctgtcctcactggcagaggaggagcgctcagtaaatgctcgctggacgaataaatggctagataagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccatttt

SEQ ID NO: 30 - DNA, 3766 bp, Homo sapiens
cccgcgcatgcgtcctccggttggcggcggctgcggcggtggcggctacgagcggctccgtttttttaaagggaaacgctgaggcgccgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaaggtgtctgatgccatcaagtgttgcaggagaaacttcagtcttggctgttccttcttggagggaccactcagtagagcctctaagggacccaaatccttcagaccttttggagaacctggatgacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgtt

SEQ ID NO: 31 - DNA, 4199 bp, Homo sapiens
cgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctt

SEQ ID NO: 32 - DNA, 3187 bp, Homo sapiens
atggcggcggcggcggcggccgccaccacggccgcctgcagcagcggcagcgccggcaccgacgccgcgggcgccagcggattgcagcagccgccgccgcagccccagcctcagcccgcggccgccgcgccggcccagccgccgcccgaacccccccggaagccgcgcatggacccgcggcgccgccaggctgccctctccttcctcaccaacatctcgctggacggccggctgccgccgcaggacgcggagtggggcggtggcgaggagggcggcgcggccaagccgggcgccggcggcgcctgcggcgcgaggactcggttcagcttgctcgccgctgccgagcggggcggctgcatcgcgctcgccgcgccgggcacgccggctgcggggttagccgctgggtccggcccctgcctcccacagccctcgtcgctgccgcccttgattcctggcggccatgcgaccgtgtccggccccggggtggcgcgggggttcgcgagtcccctgggcgccggccgggcgtcgggggagcagtggcagccgccccggccggcgcctctcgccgcctgtgcccaactgcagctgctcgacgggtccggggccgccgggcaggaggagttggaggaggacgatgcctttatcagcgtgcaggtgccggcggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccgacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatcgctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgt

SEQ ID NO: 33 - DNA, 546 bp, Homo sapiens
atggaagccatgaatgttgagaaagcctcagcagatgggaacttgccagaggtgatctctaacatcaaggagactctgaagatagtgtccaggacaccagttaacatcactatggcaggggactctggcaatgggatgtccaccttcatcagtgcccttcgaaacacaggacatgagggtaaggcctcacctcctactgagctggtaaaagctacccaaagatgtgcctcctatttctcttcccacttttcaaatgtggtgttgtgggacctgcctggcacagggtctgccaccacaaccctggagaactacctgatggaaatgcagttcaaccggtatgacttcatcatggttgcatctgcacaattcagcatgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcgggtatgtgaatactaa

SEQ ID NO: 34 - DNA, 2476 bp, Homo sapiens
tcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccatacagttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgt

SEQ ID NO: 35 - DNA, 3274 bp, Homo sapiens
cggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgcaacggaagagtcctgggcggaaggaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattatt

SEQ ID NO: 36 - DNA, 1826 bp, Homo sapiens
cagggcgcgggcgcccgccctgctctgtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggctccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatcctgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagagctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcgggtgccaccgggttccccaggggaatacatgtccccagctctgggaggggtttgctactggcctcctactttcctccctaggtggacagtgctcctctagagagctgcgactttaattaaaaacaacaggaaaacaga

SEQ ID NO: 37 - DNA, 2016 bp, Homo sapiens
tcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggttttttttttagttgccaacagttgtatgtttgctgattatttatgacctgaaataatatatttcttcttctaagaagacattttgttacataaggatgacttttttatacaatggaataaattatggcatttctattg

SEQ ID NO: 38 - DNA, 2892 bp, Homo sapiens
gggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttcc

SEQ ID NO: 39 - DNA, 1121 bp, Homo sapiens
gggccgggccgggccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctctcttccagaactgtggattcctgggagctcctctggcaataaaagtcagtgaatggtggaagtcagagaccaaccctggggattgggtgccatctctctaggggtaacacaaagggcaagaggttgctatggtatttggaaacaatgaaaatggactgttagatgccaa

SEQ ID NO: 40 - DNA, 1298 bp, Homo sapiens
atgcaggcgcttaacattaccccggagcagttctctcggctgctgcgggaccacaacctgacgcgggagcagttcatcgctctgtaccggctgcgaccgctcgtctacaccccagagctgccgggacgcgccaagctggccctcgtgctcaccggcgtgctcatcttcgccctggcgctctttggcaatgctctggtgttctacgtggtgacccgcagcaaggccatgcgcaccgtcaccaacatctttatctgctccttggcgctcagtgacctgctcatcaccttcttctgcattcccgtcaccatgctccagaacatttccgacaactggctggggggtgctttcatttgcaagatggtgccatttgtccagtctaccgctgttgtgacagaaatcctcactatgacctgcattgctgtggaaaggcaccagggacttgtgcatccttttaaaatgaagtggcaatacaccaaccgaagggctttcacaatgctaggtgtggtctggctggtggcagtcatcgtaggatcacccatgtggcacgtgcaacaacttgagatcaaatatgacttcctatatgaaaaggaacacatctgctgcttagaagagtggaccagccctgtgcaccagaagatctacaccaccttcatccttgtcatcctcttcctcctgcctcttatggtgatgcttattctgtacagtaaaattggttatgaactttggataaagaaaagagttggggatggttcagtgcttcgaactattcatggaaaagaaatgtccaaaatagccaggaagaagaaacgagctgtcattatgatggtgacagtggtggctctctttgctgtgtgctgggcaccattccatgttgtccatatgatgattgaatacagtaattttgaaaaggaatatgatgatgtcacaatcaagatgatttttgctatcgtgcaaattattggattttccaactccatctgtaatcccattgtctatgcatttatgaatgaaaacttcaaaaaaaatgttttgtctgcagtttgttattgcatagtaaataaaaccttctctccagcacaaaggcatggaaattcaggaattacaatgatgcggaagaaagcaaagttttccctcagagagaatccagtggaggaaaccaaaggagaagcattcagtgatggcaacattgaagtcaaattgtgtgaacagacagaggagaagaaaaagctcaaacgacatcttgctctctttaggtctgaactggctgagaattctcctttagacagtgggcattaatt

SEQ ID NO: 41 - DNA, 4968 bp, Homo sapiens
cagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgccggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctctatgaatgaatcacattctttctgccaacatagttttatcctgtctcagtaggatactccataacacaatagcagtacaccactaggctcttaaacgatcaagaacaatttttttcatggtgaaatcaaataacgcagttttggaaacctataaccgcattttgtgcttgaattacgtgccccacactgtggcttaggatacttattggggtataatgaaaatcttactgaaagttaatttcacattcttacaccccaaaatctgcattgccattgatgcatatgcaccacattattatatttccacatcagtttcttgtgtgccaaataagacccatgctttgcatcttggtttccatgaagtgaaaatacatagtaagaatgcgagaaatataaatcaggccaggcacggtggctcacacctgtaatcccagtactttgggaggccaaggcaagcagatcacctgaagtcaggagagaccagcctggccagcatagtgaaaccccatctctactaaaaatacaaacttagctgggcttagtggtgcatgcctgtagtctcagctacttgggaggctgaggcaggagaattgcttgaatccaagaggcagaggttctattaatggagatcattccattacactccagcctgggcaccaggaacgaaactcgttctc

SEQ ID NO: 42 - DNA, 5503 bp, Homo sapiens
ttcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctg

SEQ ID NO: 43 - DNA, 1324 bp, Homo sapiens
cccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaattactacatttgaccac

SEQ ID NO: 44 - DNA, 2669 bp, Homo sapiens
ccatcctgcagctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 45 - DNA, 2046 bp, Homo sapiens
agttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcc

SEQ ID NO: 46 - DNA, 3496 bp, Homo sapiens
atggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttcttttt

SEQ ID NO: 47 - DNA, 2976 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaa

SEQ ID NO: 48 - DNA, 3633 bp, Homo sapiens
gccaccacgtgtgtccctgcgcccggtggccaccgactcagtccctcgccgaccagtctgggcagcggaggagggtggttggcagtggctggaagcttcgctatgggaagtcgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtt

SEQ ID NO: 49 - DNA, 696 bp, Homo sapiens
atgtcaagttgctggcactgcttacaagaggagcagggtgagagggccatgaaccatgggcagtggcagaagtcgaggaaagccttggcatctccagtcacgttcacagatgacaggtcaaggtcagggtgtgaggctgcagttgagcagaatgatgagaagacaggcccagaggaagatgcaatagtcatggcaaacacccaattattggctcctttgtcctgtgggggcattttgggagattcttcaaagaccctcaatgccagagcctgctgcatcctgccccagcgcctacgtcccaccgctgtcgccgccaccgtgcccaagagaaaggctgaaggtgatgctaaaggagataaagccaaggtgaaggacaaaccacagagaagatccatgaggctgtctgccaaacctgctcctccaaagccagagcccaagcctaaaaatgcccctgcaaagaagggagagaaggtacccaaagggaaaaagggaaagctgatgctggcaaggaggggaataacccagcagaaaatggggatgccaaaagagacgaggcacagaaagctgaaggtactggagatgccaagtgaaatgtgtgcgttttttataactgtgtacttctggtgactgtacaatttgaaatactatttttatcaagttttataaaaatgcagaattttgttttacttttttttt

SEQ ID NO: 50 - DNA, 3638 bp, Homo sapiens
gccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatactt

SEQ ID NO: 51 - DNA, 5051 bp, Homo sapiens
atgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtg

SEQ ID NO: 52 - DNA, 6369 bp, Homo sapiens
gtggaatgacgggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagc

SEQ ID NO: 53 - DNA, 3623 bp, Homo sapiens
actcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataagg

SEQ ID NO: 54 - DNA, 3472 bp, Homo sapiens
gccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcat

SEQ ID NO: 55 - DNA, 1305 bp, Homo sapiens
acgagggagcttgtgctcacgcagaccgggcagtgcgggaaccagatcggcgccaagttctgggaggtgatctctgatgaacatgccatcgactccgctggcacctaccacggggacagccacctgcagctggagcgcatcaacgtgcaccaccacgaggccagcggtggcaggtacgtgtcccgcgctgtgctcgtggatctggagccgggcaccatggactctgtgcgctcggggcccttcgggcaggtcttcaggccagacaacttcatttcccgtcagtgtggggccggaaacaactgggccaagggacgctacaccgaaggcgcggagctgacggagtcagtgatggacgttgtcagaaaggaggctgagagctgtgactgcctgcagggtttccagctgacccactccctgggtggggggactgggtctgggatgggtacccttctcattagtaagatctgggaggagtacccagacaggattataaacacattgagcatcctgctcttgcccaaggtgtcagacaccgtggtggagccctacaacgccaccctctcagtccaccagctcatagaaaacgcagatgagaccttctgcatagataacgaagcgctatatgacatatgttccaggaccctaaaactgcccacacccacctatggtgacctgaaccacctggtgtctgctaccatgagtggggtcaccacgtgcctgtgcttccccgaccagctgaatgctgacctgcggaagctggccatgaacatggtcccgtttccccggctgcatttcttcatgcccggctttgccccactgaccagccggggcagccagcagtaccgggccttgactgtggctgagctcacccagcagatgtttgatgctaagaacatgatggctgcccgtgacccccgtcacggccgctacctaacggcggctgccattttccagggtcgcatgcccatgagggaggtggatgaacagatgttcaacattcaagataagaacagcagctactttgctgactggttccccaacaacgtaaaaacagccgtctgtgacatcccaccctgggggctaaaaatgtcagtcaccttcactgggaacaacacagccgtccaggaactcaagcgggtctcagagcagtttacagcaacgttcaggcgcaaggccttcctccactggtacacgggcgagggcatggatgagatggaattcactgaggccgagagcaacatgaacgacttggtgtctgaatatcagcaatatcaggatgccacggccgagggaggaggagtatga

SEQ ID NO: 56 - DNA, 1768 bp, Homo sapiens
gaacttgcgcgggagccggactgagcggtgcgagcgcgcaggcgcggccgacggggcgggctgctactccggaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccata

SEQ ID NO: 57 - DNA, 2836 bp, Homo sapiens
agccaatgggagttcaggaggcggagcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccaga

SEQ ID NO: 58 - DNA, 1860 bp, Homo sapiens
atcactcctagctgctcagcaaaccactgaggttcctgggaaaaaaaaaaaaatatctcaagggtgtgttaacttgggacactcgttaactgggggaccttcttgaggcttttttccttctttttaaaaatcatctttgattattcttcttttctagtaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtaacattaccaatagaactaaat

SEQ ID NO: 59 - DNA, 2221 bp, Homo sapiens
tcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttgactgtacagagactctattttaatgtatatttgctgcaaagagaaaccgcttttggttttaaacctttaatgagaaaaaaatatataataccgagctc

SEQ ID NO: 60 - DNA, 796 bp, Homo sapiens
atccgcccaggcatgtgcacacacacatgcatatgtgcacgcaccgtgcaggcccgctgtctggcccacaagcgcagccctcctccccaggacacctggcatgttacatgcctccaccatctggcatctccggtccacccctccccggaggaaacaatggggccactgtgacccacacagaattctggtagcctctgaggtcaccacagagataacctcaccaacccctgcaccaagagcacaagtctgtggaggccagccgtgggtgaccgtccttgatcctctttctggccacacagggagagaagcagaaaggcacttcgccactgtctccatcagtgctgttgaactcaaatactgccatgggtggaggccagcagggcagcgtgtccctagcaagacagcgactgggcaacgcacctgtgccaaaccctgccagaagcccagcacgtccaaggtgatcctgagggctgtggcggacaaggggacctgcaagtatgtgtccctggccaccctgaagaaggctgtttccaccacgggctacgacatggcccgaaatgcctatcacttcaagcgtgtgctcaaggggctggtggacaagggctcagcaggctccttcaccctgggcaagaagcaggcctccaagtccaagctcaaggtcaagaggcaacgacagcagaggtggcgctctgggcagcgcccctttggacagcacaggtcactactgggctccaaacaggggcacaagcggcttatcaagggggttcgaagggtggccaagtgccactgcaattaa

SEQ ID NO: 61 - DNA, 3007 bp, Homo sapiens
accgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaacatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttt

SEQ ID NO: 62 - DNA, 2092 bp, Homo sapiens
gccagccacagcagagaggtgggggttgtgaccggagttagatgccagcgcagaagggacgtgagcccagccgaggtaccgctgaagaggaatcaattttggtatgcagataatcactgggctcatgggtcttgctctttacaaagagaattcagcggggtgccaagtcgttttctgtgtgggttgagagacaggctgtgcagcccactgttgcataggactaactactacaaatcatgctgagaccgagctatttttgctgcttagaggctttgcagccttgagaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatcta

SEQ ID NO: 63 - DNA, 4769 bp, Homo sapiens
atgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagatttatgtggaggaggacttggcccagcaggacaaggatgaaataattctgctgctgggaaaagaggtcagccgtctctcagattatgaaattgaatccaaatacaaagacgtcataatagcaaacctgcagaatgaagtggctgagctgagtcagaaggtgtcagagaccaccacctccaggcagaatgagaaggagatctcgcagaagtgtcaggttctggatgaagacatcgatgccaaacagaaagagatccagagcttgaaaagccagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaaaggaagccttggagtcggaaaagagaaaagttcaggatctggagaaccatttaacccaacagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctgggaaagtgtagaggagcacgaactgagaaacgcaaaagaatcgacaccttgcaactgtgccttcaaagagaaagacaggcagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtcttt

SEQ ID NO: 64 - DNA, 3015 bp, Homo sapiens
gcggcgggcgagcggagcggcgcgcctgtccggagctcggcggtggcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaacctttttgttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaagatttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaaaaggttcaatttt

SEQ ID NO: 65 - DNA, 2439 bp, Homo sapiens
cgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattg

SEQ ID NO: 66 - DNA, 1437 bp, Homo sapiens
ggagataagattcagaggttgaggatggggtgtcctggtggactgaaggtagcctactagctgtacatgggtgacaacttgaaacttcagaaccctgaagtttaaaaaattctaaaggtgcctgtcatctcagagagtgacgtaagtgttctttctttatttgggggaagtccaggagaacatattacagacatgtttaatccacatgcattagatgttcctgctgtaatttttgacaatggttcaggactctgcaaagcaggcctgtctggagagattggaccccgccatgtcatcagctccgtcttgggacattgtaaattcaatgtgcctttagcaagacttaatcagaagtacttcgtggggcaagaagccctgtacaagtatgaggccctacatttgcactaccccattgagcgtggactggtaacaggatgggatgacatggagaaactctggaaacatctctttgagcgggagcttggagtaaaacccagccaacagcctgtacttatgaccgagccctctttgaatcctagggaaattcgagaaaagctagcagaaatgatgtttgagaccttcagtgtgcctggtttctacctgtctaatcatgcggtggcagcgctctatgcctctgcctgtgtcacaggcctggtggtggacagtggagatggggtcacttgcactgtccccatctttgagggttactccctgcctcacgcagtcaccaaactctgtatggcagggagggacatcacagagcacctcacccggctcctctttgctagcgggtttaacttcccttgcatactcaacaaggccgtggtaaataacatcaaagagaagttgtgctacatcgccttggagccagagaaagagctacgcaagagccggggagaggtcctgggagcatacagactgccagatggacatgtcatccactttggggatgagctgtaccaagtgcccgaggttctttttgcacctgaccagctgggcatccacagcccaggactctcaaaaatggtctccagcagcatcatgaagtgtgacactgacatccagaataaactttatgcagacattgtactctccgggggcaccactctcctccctgggctggaggaaaggctcatgaaggaagtggaacagctggcttccaaaggtactcccatcaagatcacagcttctcctgatagatgcttctctgcatggattggtgcatccatcatgacctctatgagcagtttcaagcagatgtgggtcacctcggcagacttcaaggagtatgggacatctgtggttcaaagaaggtgcttttaaagatccttgagcagaggagacatcttgaagtgtcagattacaggagtaccagtgggagatggcattttcttctgggcttcagcatgatgttcaataaaagttttgccatttcaa

SEQ ID NO: 67 - DNA, 2370 bp, Homo sapiens
gcagcgccggtcgggagcgcagcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggcgcccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttcttt

SEQ ID NO: 68 - DNA, 1075 bp, Homo sapiens
gttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 69 - DNA, 1308 bp, Homo sapiens
atgccgatgtcttctcttccagcagctattttgtctcacatgacagctattaacaatgtgcctcctcctccacttcacagtataccaaacttgaaaaagtctaagcacattaattatggccagttgaatgcattatgccacattagaggacaacacagccggagtatgagcaatatcttatcagctcacgatacatttatgaagcaatatcctaaagtattcctgcaccaaaaacccagacttcctaaacttttcaaacaggaggaacaaagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgcccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatgcttagcaaatggagtacctttgggactctggaagttatgcctcagaatgaatcggaaacacagatgttctcggtggtgacagaagacgattgtgaaattcttaaaatcccagcaaagggatatgcaaagataaaggaggaaaaaataaaacttgaaaatatgcaaaagttgaaattaatccgtatgtgtccttattatgaggaatggcctactttatccatatatgagctaattgcactccttaaatggaaaaaatttcctccaggtcatgtgatagtggaaagtggaaatataatttcttttgtgggttatattaactctggatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgatgca

SEQ ID NO: 70 - DNA, 3021 bp, Homo sapiens
atttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccc

SEQ ID NO: 71 - DNA, 1081 bp, Homo sapiens
agtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgc

SEQ ID NO: 72 - DNA, 3161 bp, Homo sapiens
agcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatggtcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtg

SEQ ID NO: 73 - DNA, 1520 bp, Homo sapiens
gcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagc

SEQ ID NO: 74 - DNA, 5840 bp, Homo sapiens
gtctccactagaggctgcacagcccgcccggaccaacgcctccgcgcctgccgccgtctggccggcgccctcccgtttccttcctccagggggaaaaaatgtctttcgggccgctttccaggaagcagcaggatgcgccgctccactgtcggtagcaacaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggtaaacactaccctcccagtggcccaccaatgagtttcgctgatataatgtggaggaatcattttgcaggacgcatggggataaatttccatcatccaggaacagataatattatggcacttaacaatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtatggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagaatgagcag

SEQ ID NO: 75 - DNA, 438 bp, Homo sapiens
atgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtat

SEQ ID NO: 76 - DNA, 1908 bp, Homo sapiens
agcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccagtcatattgatgttaccatta

SEQ ID NO: 77 - DNA, 7230 bp, Homo sapiens
cattttgtctcctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagct

SEQ ID NO: 78 - DNA, 3158 bp, Homo sapiens
cccacgcacgggcctcggacgcatttccagccccggcgttggttgtggatgctggacatccaccgcctccaggcagtttcgccgtcacaccgtcgccatctgtagccaaagcaaaacatatcctaactgagactttgcagctcttgtggccactctgggctcaccgggaacatgagtggaagagcccgagtgaaggccagaggcatcgcccgcagccccagtgccacagaagtggggcgcatccaagcctcgccattgcctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacaaagcaaaagcattcgacggtgccatcctttttctgtcacaaaagctagaagaaaaggtcacagagttgtcaagtgaaactcaaagaggtgagactataaagatgactatcaccctgaagagggagctgccatcaagttctcccgtgtgcatccaggtcttcaatatcatcttcagaaagatcctcaaaaagttgtccatgtaccaaattggacggaacttctataatccttcagagccaatggaaattccccagcacaaattatccctttggcctgggtttgccatttctgtgtcatattttgaaaggaagctcctgtttagtgctgatgtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactaccccaaaatcataaaagtacaagaaaatccagctgcatttgttagagctatacagcaatatgttgatcctgatgttcagctggtaatgtgcattctgccttctaatcagaagacctattatgattccattaaaaaatatttgagctcagactgcccagtcccaagccaatgtgtgcttgctcggaccttgaataaacagggcatgatgatgagtatcgccaccaagatcgctatgcagatgacttgcaagctcggaggcgagctgtgggctgtggaaatacctttaaagtccctgatggtggtcggtattgatgtctgtaaagatgcactcagcaaggacgtgatggttgttggatgcgtggccagtgttaaccccagaatcaccaggtggttttcccgctgtatccttcagagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgacagataaacagagtctaattcccaccccaaattttgctgaggttttcttaatgttgtagagcattttgtagagtggtttaaatagttgaaaataaagttcagaacatc

SEQ ID NO: 79 - DNA, 5685 bp, Homo sapiens
gcccagacgcacaccgcgcatgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcagggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccctgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaa

SEQ ID NO: 80 - DNA, 2043 bp, Homo sapiens
aggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagg

SEQ ID NO: 81 - DNA, 10686 bp, Homo sapiens
gcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgt

SEQ ID NO: 82 - DNA, 3142 bp, Homo sapiens
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttc

SEQ ID NO: 83 - DNA, 2152 bp, Homo sapiens
ctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagcc

SEQ ID NO: 84 - DNA, 1245 bp, Homo sapiens
atggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaa

SEQ ID NO: 85 - DNA, 2768 bp, Homo sapiens
cactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtc

SEQ ID NO: 86 - DNA, 1916 bp, Homo sapiens
gggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtc

SEQ ID NO: 87 - DNA, 1139 bp, Homo sapiens
ccacgttgtcttctttccttcaccaccacccaggagctcagagatctaagctgctttccatcttttctcccagccccaggacactgactctgtacaggatggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctgggatggctgtcactggctgtgcttgtggctatggctgtggttcgtgggatgttcagctggaaaccacctgccactgccagtgcagtgtggtggactggaccactgcccgctgctgccacctgacctgacagggaggaggctgagaactcagttttgtgaccatgacagtaatgaaaccagggtcccaaccaagaaatctaactcaaacgtcccacttcatttgttccattcctgattcttgggtaataaagacaaactttgtacctctctgtgcttatgtcatctctgttattgtccccagcttggggctcccctatccagaaaatgttgtcagtgtcccagtggtgacatctcagtttgggaagtgggatgggaagttaggaaagatatgggaagaatgggaaaaacaaactgacactccaaacccccacttccctcatttttatttatttatttatttatttttttcttttttttcattttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccatcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcata

SEQ ID NO: 88 - DNA, 3105 bp, Homo sapiens
gcggagcgtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgc

SEQ ID NO: 89 - DNA, 5354 bp, Homo sapiens
cagccggcggcgggctgggtgtttgcaatacaaaggcggccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctg

SEQ ID NO: 90 - DNA, 3314 bp, Homo sapiens
cggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtg

SEQ ID NO: 91 - DNA, 1242 bp, Homo sapiens
cggacgcgtgggccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgcgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattat

SEQ ID NO: 92 - DNA, 1799 bp, Homo sapiens
cacccggcgctccaagttcggggctggaggcgtcccggcttcctccctcccggagcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaa

SEQ ID NO: 93 - protein, 829 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDVVIPLDHEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNVGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 94 - protein, 1182 aa, Homo sapiens
MESLLENPVRAVLYLKELTAIVQNQQSLIHTQRERIDELERRLDELSAENRSLWEHQQLLQAQPPPGLVPPSSAPLPAAPATAPAAAARAQEPLQDQGQRSAAAPHPAPDRPPRQHHGQLLEQPQRGPGSRAHTPQSPHKHLGTQGAVTDKEKERPPSCCAAAGALLQHKSPSALGKGVLSRRPENETVLHQFCCPAADACSDLASQSDGSCTQAGGGMEDSVVAAAAVAAGRPSAHAPKAQAQELQEEEERPGAGAASPRAGPQHKASPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVSIHNRLQTSQHNSGLGAERGAPVPPPDLQPSPPRQQTPPLPPPPPTPPGTLVQCQQIVKVIVLDKPCLARMEPLLSQALSCYTSSSSDSCGSTPLGGPGSPVKVTHQPPLPPPPPPYNHPHQFCPPGSLLHGHRYSSGSRSLV

SEQ ID NO: 95 - protein, 139 aa, Homo sapiens
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 96 - protein, 243 aa, Homo sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 97 - protein, 967 aa, Homo sapiens
MGPGQPASTCVHLAPRTQLDGRSDPKVLQTQNQLQFNRNVPTHSSNLAIRYSCPHAIRIEKLKHSYNESYHCKDADCRVGPDLGSSVSFSVISQERLSYAVHLARRDVKRRQFEKHIKEHHLRSQPQSSQKCGHTKYKIPDHRVERKESKSQAACQCSHQPSKVEISSSGAKVYLYSSHPGQSDLTVPNSPPTHDPGLQPHPRIGDHKNISEQKSLLEVQRLQKELSSCIHKIEEVTKKDRLEEALDPDEERRIRIRRQEQAARSARMLYVLQQQVKEIQEELDKLSPHKIKHTKKSWAMSKLAAAHRGAIRALQMFVTQFTDRGEHPLPARCKELGSLIRQLSLCSVKLDADPSVPDVVIDILQQIEALESLLEKKLSPKKVKKCFSEIRSRFPIGSQKALERWPSTSPKGERRPLTAKDTFPQETSRPSVAKQLLADKYQPDTELPETQRLQSELDVLDADIVLEEGPFILDQSASFKDEVLAVAKTKAGKKKPVTENVPFRKKDTLAPARQQGLRKAERGRQSQPHSKSRVQQTTVSSRLKMNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 98 - protein, 690 aa, Homo sapiens [sequence omitted]

SEQ ID NO: 99 - protein, 303 aa, Homo sapiens
MSSAPASGSVRARYLVYFQYVGTDFNGVAAVRGTQRAVGVQNYLEEAAERLNSVEPVRFTISSRTDAGVHALSNAAHLDVQRRSGRPPFPPEVLAEALNTHLRHPAIRVLRAFRVPSDFHARHAATSRTYLYRLATGCHRRDELPVFERNLCWTLPADCLDMVAMQEAAQHLLGTHDFSAFQSAGSPVPSPVRTLRRVSVSPGQASPLVTPEESRKLRFWNLEFESQSFLYRQVRRMTAVLVAVGLGALAPAQVKTILESQDPLGKHQTRVAPAHGLFLKSVLYGNLGAASCTLQGPQFGSHG

SEQ ID NO: 100 - protein, 351 aa, Homo sapiens
MEPAPGLVEQPKCLEAGSPEPEPAPWQALPVLSEKQSGDVELVLAYAAPVLDKRQTSRLLKEVSALHPLPAQPHLKRVRPSRDAGSPHALEMLLCLAGPASGPRSLAELLPRPAVDPRGLGQPFLVPVPARPPLTRGQFEEARAHWPTSFHEDKQVTSALAGRLFSTQERAAMQSHMERAVWAARRAAARGLRAVGAVVVDPASDRVLATGHDCSCADNPLLHAVMVCVDLVARGQGRGTYDFRPFPACSFAPAAAPQAVRAGAVRKLDADEDGLPYLCTGYDLYVTREPCAMCAMALVHARILRVFYGAPSPDGALGTRFRIHARPDLNHRFQVFRGVLEEQCRWLDPDT

SEQ ID NO: 101 - protein, 422 aa, Homo sapiens
MSFVECPYHSPAERLVAEADEGGPSAITGMGLCFRCLLFSFSGRSGVEGGRVDLNVFGSLGLQPWIGSSRCWGGPCSSALRCGWFSSWPPPSKSAIPIGGGSRGAGRVSRWPPPHWLEAWRVSPLPLSPLSPATFGRGFIAVAVIPGLWARGRGCSSDRLPRPAGPARRQFQAASLLTRGWGRAWPWKQILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 102 - protein, 271 aa, Homo sapiens
MAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 103 - protein, 520 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 104 - protein, 163 aa, Homo sapiens
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 105 - protein, 562 aa, Homo sapiens
RHSTAVKMAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 106 - protein, 511 aa, Homo sapiens
MSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 107 - protein, 549 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 108 - protein, 1146 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCCPADGPEQCELVQRPRYRRGPHICFDYNATEDTSDCGRGASFPPSLGVLVSLQLLLLLGLPPRPQPQVLVHASRRL

SEQ ID NO: 109 - protein, 281 aa, Homo sapiens
MFPAQEEADRTVFVGNLEARVREEILYELFLQAGPLTKVTICKDREGKPKSFGFVCFKHPESVSYAIALLNGIRLYGRPINVQYRFGSSRSSEPANQSFESCVKINSHNYRNEEMLVGRSSFPMQYFPINNTSLPQEYFLFQKMQWHVYNPVLQLPYYEMTAPLPNSASVSSSLNHVPDLEAGPSSYKWTHQQPSDSDLYQMTAPLPNSASVSSSLNHVPDLEAGPSSYKWTHQQPSDSDLYQMNKRKRQKQTSDSDSSTDNNRGNECSQKFRKSKKKKRY

SEQ ID NO: 110 - protein, 673 aa, Homo sapiens
MASQFCLPESPCLSPLKPLKPHFGDIQEGIYVAIQRSDKRIHLAVVTEINRENYWVTVEWVEKAVKKGKKIDLETILLLNPALDSAEHPMPPPPLSPLALAPSSAIRDQRTATKWVAMIPQKNQTASGDSLDVRVPSKPCLMKQKKSPCLWEIQKLQEQREKRRRLQQEIRARRALDVNTRNPNYEIMHMIEEYRRHLDSSKISVLEPPQEHRICVCVRKRPLNQRETTLKDLDIITVPSDNVVMVHESKQKVDLTRYLQNQTFCFDHAFDDKASNELVYQFTAQPLVESIFRKGMATCFAYGQTGSGKTYTMGGDFSGTAQDCSKGIYALVAQDVFLLLRNSTYEKLDLKVYGTFFEIYGGKVYDLLNWKKKLQVLEDGNQQIQVVGLQEKEVCCVEEVLNLVEIGNSCRTSRQTPVNAHSSRSHAVFQIILKSGRIMHGKFSLVDLAGNERGADTTKASRKRQLEGAEINKSLLALKECILALGQNKPHTPFRASKLTLVLRDSFIGQNSSTCMIATISPGMTSCENTLNTLRYANRVKKLNVDVRPYHRGHYPIGHEAPRMLKSHIGNSEMSLQRDEFIKIPYVQSEEQKEIEEVETLPTLLGKDTTISGKGSSQWLENIQERAGGVHHDIDFCIARSLSILEQKIDALTEIQKKLKLLLADLHVKSKVE

SEQ ID NO: 111 - protein, 1663 aa, Homo sapiens
MKDAAEELSFARVLLQRVDELEKLFKDREQFLELVSRKLSLVPGAEEVTMVTWEELEQAITDGWRASQAGSETLMGFSKHGGFTSLTSPEGTLSGDSTKQPSIEQALDSASGLGPDRTASGSGGTAHPSDGVSSREQSKVPSGTGRQQQPRARDEAGVPRLHQSSTFQFKSDSDRHRSREKLTSTQPRRNARPGPVQQDLPLARDQPSSVPASQSQVHLRPDRRGLEPTGMNQPGLVPASTYPHGVVPLSMGQLGVPPPEMDDRELIPFVVDEQRMLPPSVPGRDQQGLELPSTDQHGLVSVSAYQHGMTFPGTDQRSMEPLGMDQRGCVISGMGQQGLVPPGIDQQGLTLPVVDQHGLVLPFTDQHGLVSPGLMPISADQQGFVQPSLEATGFIQPGTEQHDLIQSGRFQRALVQRGAYQPGLVQPGADQRGLVRPGMDQSGLAQPGADQRGLVWPGMDQSGLAQPGRDQHGLIQPGTGQHDLVQSGTGQGVLVQPGVDQPGMVQPGRFQRALVQPGAYQPGLVQPGADQIDVVQPGADQHGLVQSGADQSDLAQPGAVQHGLVQPGVDQRGLAQPRADHQRGLVPPGADQRGLVQPGADQHGLVQPGVDQHGLAQPGEVQRSLVQPGIVQRGLVQPGAVQRGLVQPGAVQRGLVQPGVDQRGLVQPGAVQRGLVQPGAVQHGLVQPGADQRGLVQPGVDQRGLVQPGVDQRGLVQPGMDQRGLIQPGADQPGLVQPGAGQLGMVQPGIGQQGMVQPQADPHGLVQPGAYPLGLVQPGAYLHDLSQSGTYPRGLVQPGMDQYGLRQPGAYQPGLIAPGTKLRGSSTFQADSTGFISVRPYQHGMVPPGREQYGQVSPLLASQGLASPGIDRRSLVPPETYQQGLMHPGTDQHSPIPLSTGLGSTHPDQQHVASPGPGEHDQVYPDAAQHGHAFSLFDSHDSMYPGYRGPGYLSADQHGQEGLDPNRTRASDRHGIPAQKAPGQDVTLFRSPDSVDRVLSEGSEVSSEVLSERRNSLRRMSSSFPTAVETFHLMGELSSLYVGLKESMKDLDEEQAGQTDLEKIQFLLAQMVKRTIPPELQEQLKTVKTLAKEVWQEKAKVERLQRILEGEGNQEAGKELKAGELRLQLGVLRVTVADIEKELAELRESQDRGKAAMENSVSEASLYLQDQLDKLRMIIESMLTSSSTLLSMSMAPHKAHTLAPGQIDPEATCPACSLDVSHQVSTLVRRYEQLQDMVNSLAVSRPSKKAKLQRQDEELLGRVQSAILQVQGDCEKLNITTSNLIEDHRQKQKDIAMLYQGLEKLEKEKANREHLEMEIDVKADKSALATKVSRVQFDATTEQLNHMMQELVAKMSGQEQDWQKMLDRLLTEMDNKLDRLELDPVKQLLEDRWKSLRQQLRERPPLYQADEAAAMRRQLLAHFHCLSCDRPLETPVTGHAIPVTPAGPGLPGHHSIRPYTVFELEQVRQHSRNLKLGSAFPRGDLAQMEQSVGRLRSMHSKMLMNIEKVQIHFGGSTKASSQIIRELLHAQCLGSPCYKRVTDMADYTYSTVPRRCGGSHTLTYPYHRSRPQHLPRGLYPTEEIQIAMKHDEVDILGLDGHIYKGRMDTRLPGILRKDSSGTSKRKSQQPRPHVHRPPSLSSNGQLPSRPQSAQISAGNTSER

SEQ ID NO: 112 - protein, 380 aa, Homo sapiens
MASLPVLQKESVFQSGAHAYRIPALLYLPGQQSLLAFAEQRASKKDEHAELIVLRRGDYDAPTHQVQWQAQEVVAQARLDGHRSMNPCPLYDAQTGTLFLFFIAIPGQVTEQQQLQTRANVTRLCQVTSTDHGRTWSSPRDLTDAAIGPAYREWSTFAVGPGHCLQLHDRARSLVVPAYAYRKLHPIQRPIPSAFCFLSHDHGRTWARGHFVAQDTLECQVAEVETGEQRVVTLNARSHLRARVQAQSTNDGLDFQESQLVKKLVEPPPQGCQGSVISFPSPRSGPGSPAQWLLYTHPTHSWQRADLGAYLNPRPPAPEAWSEPVLLAKGSCAYSDLQSMGTGPDGSPLFGCLYEANDYEEIVFLMFTLKQAFPAEYLPQ

SEQ ID NO: 113 - protein, 541 aa, Homo sapiens
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 114 - protein, 96 aa, Homo sapiens
MAEVEETLKRIQSHKGVIGTMVVNAEGIPIRTTLDNSTTVQYAGLLHHLTMKAKSTVRDIDPQNDLTFLRIRSKKHEIMVAPDKEYLLIVIQNPCE

SEQ ID NO: 115 - protein, 452 aa, Homo sapiens
MACRSCVVGFSSLSSCEVTPVGSPRPGTSGWDSCRAPGPGFSSRSLTGCWSAGTISKVTVNPGLLVPLDVKLDPAVQQLKNQEKEEMKALNDKFASLIGKVQALEQRNQLLETRWSFLQGQDSAIFDLGHLYEEYQGRLQEELRKVSQERGQLEANLLQVLEKVEEFRIRYEDEISKRTDMEFTFVQLKKDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAASRSGLSKAPSRKKKGSKGPVIKITEMSEKYFSQESEVSE

SEQ ID NO: 116 - protein, 359 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 117 - protein, 703 aa, Homo sapiens
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETI

SEQ ID NO: 118 - protein, 346 aa, Homo sapiens
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALALTARSLPAVQSDERLQPLLNHLSHSYTSQDYSTQGNVGKISLDQIDLLSTKSFPLYMHQLHKALRENHHLCHGGRMQYVLFLKGIGLTLEQTLQFWKQEFIKGKMDPDKFDKGYS

SEQ ID NO: 119 - protein, 399 aa, Homo sapiens
MDSQGRKVVVCDNGTGFVKCGYAGSNFPEHIFPALVGRPIIRSTTKVGNIEIKINKKKDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 120 - protein, 376 aa, Homo sapiens
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 121 - protein, 413 aa, Homo sapiens
MRKSPLGGGGGSGASSQAACLKQILLLQLDLIEQQQQQLQAKEKEIEELKSERDTLLARIERMERRMQLVKKDNEKERHKLFQGYETEEREETELSEKIKLECQPELSETSQTLPPKPFSCGRSGKGHKRKSPFGSTERKTPVKKLAPEFSKVKTKTPKHSPIKEEPCGSLSETVCKRELRSQETPEKPRSSVDTPPRLSTPQKGPSTHPKEKAFSSEIEDLPYLSTTEMYLCRWHQPPPSPLPLRESSPKKEETVARCLMPSSVAGETSVLAVPSWRDHSVEPLRDPNPSDLLENLDDSVFSKRHAKLELDEKRRKRWDIQRIREQRILQRLQLRMYKKKGIQESEPEVTSFFPEPDDVESLMITPFLPVVAFGRPLPKLTPQNFELPWLDERSRCRLEIQKKQTPHRTCRK

SEQ ID NO: 122 - protein, 730 aa, Homo sapiens
MLFNSVLRQPQLGVLRNGWSSQYPLQSLLTGYQCSGNDEHTSYGETGVPVPPFGCTFSSAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRAKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKKLPSPVTITPSSMRKICTYFHRKSQEDFCGPEHSTEL

SEQ ID NO: 123 - protein, 633 aa, Homo sapiens
MAAAAAAATTAACSSGSAGTDAAGASGLQQPPPQPQPQPAAAAPAQPPPEPPRKPRMDPRRRQAALSFLTNISLDGRLPPQDAEWGGGEEGGAAKPGAGGACGARTRFSLLAAAERGGCIALAAPGTPAAGLAAGSGPCLPQPSSLPPLIPGGHATVSGPGVARGFASPLGAGRASGEQWQPPRPAPLAACAQLQLLDGSGAAGQEELEEDDAFISVQVPAAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 124 - protein, 181 aa, Homo sapiens
MEAMNVEKASADGNLPEVISNIKETLKIVSRTPVNITMAGDSGNGMSTFISALRNTGHEGKASPPTELVKATQRCASYFSSHFSNVVLWDLPGTGSATTTLENYLMEMQFNRYDFIMVASAQFSMNHVMLAKTAEDMGKKFYIVWTKLDMDLSTGALPEVQLLQIRENVLENLQKERVCEY

SEQ ID NO: 125 - protein, 303 aa, Homo sapiens
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 126 - protein, 913 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 127 - protein, 517 aa, Homo sapiens
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 128 - protein, 367 aa, Homo sapiens
MVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 129 - protein, 602 aa, Homo sapiens
MPSAKQRGSKGGHGAASPSEKGAHPSGGADDVAKKPPPAPQQPPPPPAPHPQQHPQQHPQNQAHGKGGHRGGGGGGGKSSSSSSASAAAAAAAASSSASCSRRLGRALNFLFYLALVAAAAFSGWCVHHVLEEVQQVRRSHQDFSRQREELGQGLQGVEQKVQSLQATFGTFESILRSSQHKQDLTEKAVKQGESEVSRISEVLQKLQNEILKDLSDGIHVVKDARERDFTSLENTVEERLTELTKSINDNIAIFTEVQKRSQKEINDMKAKVASLEESEGNKQDLKALKEAVKEIQTSAKSREWDMEALRSTLQTMESDIYTEVRELVSLKQEQQAFKEAADTERLALQALTEKLLRSEESVSRLPEEIRRLEEELRQLKSDSHGPKEDGGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 130 - protein, 288 aa, Homo sapiens
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 131 - protein, 431 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 132 - protein, 818 aa, Homo sapiens
MALTQVRLTFRDVAIEFSQEEWKCLDPAQRILYRDVMLENYWNLVSLGLCHFDMNIISMLEEGKEPWTVKSCVKIARKPRTPECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYK

SEQ ID NO: 133 - protein, 808 aa, Homo sapiens
MAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQ

SEQ ID NO: 134 - protein, 122 aa, Homo sapiens
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERSVKEAEDNIREMLMARRAQ

SEQ ID NO: 135 - protein, 375 aa, Homo sapiens
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 136 - protein, 448 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 137 - protein, 442 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 138 - protein, 738 aa, Homo sapiens
MHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQKLMMSQRESLMSHAIELKSGSNKNIHIALATLALNYSVCFHKDHNIEGKAQCLSLISTILEVVQDLEATFRLLVALGTLISDDSNAVQLAKSLGVDSQIKKYSSVSEPAKVSECCRFILNLL

SEQ ID NO: 139 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 140 - protein, 655 aa, Homo sapiens
PQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDEVLPCLLSPFSLLLYHLPSVSITSLLRQLMNLPQSAATPALSNPHLTAVLQNKFGLSLLLILLSRGEDLQSSDPATESTQNNQWTEVMFMATRELLRIPQAALAKPISIPTNLVSLFSRYVDRQKLNLLETKLQLVQGIR

SEQ ID NO: 141 - protein, 1452 aa, Homo sapiens
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 142 - protein, 1591 aa, Homo sapiens
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 143 - protein, 999 aa, Homo sapiens
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 144 - protein, 619 aa, Homo sapiens
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 145 - protein, 433 aa, Homo sapiens
RELVLTQTGQCGNQIGAKFWEVISDEHAIDSAGTYHGDSHLQLERINVHHHEASGGRYVSRAVLVDLEPGTMDSVRSGPFGQVFRPDNFISRQCGAGNNWAKGRYTEGAELTESVMDVVRKEAESCDCLQGFQLTHSLGGGTGSGMGTLLISKIWEEYPDRIINTLSILLLPKVSDTVVEPYNATLSVHQLIENADETFCIDNEALYDICSRTLKLPTPTYGDLNHLVSATMSGVTTCLCFPDQLNADLRKLAMNMVPFPRLHFFMPGFAPLTSRGSQQYRALTVAELTQQMFDAKNMMAARDPRHGRYLTAAAIFQGRMPMREVDEQMFNIQDKNSSYFADWFPNNVKTAVCDIPPWGLKMSVTFTGNNTAVQELKRVSEQFTATFRRKAFLHWYTGEGMDEMEFTEAESNMNDLVSEYQQYQDATAEGGGV

SEQ ID NO: 146 - protein, 254 aa, Homo sapiens
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 147 - protein, 862 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 148 - protein, 560 aa, Homo sapiens
MSEHSRNSDQEELLDEEINEDEILANLSAEELKELQSEMEVMAPDPSLPVGMIQKDQTDKPPTGNFNHKSLVDYMYWEKASRRMLEEERVPVTFVKSEEKTQEEHEEIEKRNKNMAQYLKEKLNNEIVANKRESKGSSNIQETDEEDEEEEDDDDDDEGEDDGEESEETNREEEGKAKEQIRNCENNCQQVTDKAFKEQRDRPEAQEQSEKKISKLDPKKLALDTSFLKVSTRPSGNQTDLDGSLRRVRKNDPDMKELNLNNIENIPKEMLLDFVNAMKKNKHIKTFSLANVGADENVAFALANMLRENRSITTLNIESNFITGKGIVAIMRCLQFNETLTELRFHNQRHMLGHHAEMEIARLLKANNTLLKMGYHFELPGPRMVVTNLLTRNQDKQRQKRQEEQKQQQLKEQKKLIAMLENGLGLPPGMWELLGGPKPDSRMQEFFQPPPPRPPNPQNVPFSQRSEMMKKPSQAPKYRTDPDSFRVVKLKRIQRKSRMPEAREPPEKTNLKDVIKTLKPVPRNRPPPLVEITPRDQLLNDIRHSSVAYLKPVTLPIELN

SEQ ID NO: 149 - protein, 423 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 150 - protein, 231 aa, Homo sapiens
MLHASTIWHLRSTPPRRKQWGHCDPHRILVASEVTTEITSPTPAPRAQVCGGQPWVTVLDPLSGHTGREAERHFATVSISAVELKYCHGWRPAGQRVPSKTATGQRTCAKPCQKPSTSKVILRAVADKGTCKYVSLATLKKAVSTTGYDMARNAYHFKRVLKGLVDKGSAGSFTLGKKQASKSKLKVKRQRQQRWRSGQRPFGQHRSLLGSKQGHKRLIKGVRRVAKCHCN

SEQ ID NO: 151 - protein, 477 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 152 - protein, 369 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 153 - protein, 785 aa, Homo sapiens
MTSLEPCRLFIYGKTERMKAYLKSAEGFFVLNKSTTIGRHENSDLVLQSPDIDNHHALIEYNEAECSFVLQDFNSRNGTFVNECHIQNVAVKLIPGDILRFGSAGLTYELVIENPPPVSFPWMRGPAPWPGPQPPRATQQPNQAPPPSHIPFHQGVQPAPMQRSWSQAFPRPTVVLPASHRRPVSANKEMFSFVVDDARKPPVIKQVWTNAMKLSEKSVAEGIPGAVPPAEIYVEEDLAQQDKDEIILLLGKEVSRLSDYEIESKYKDVIIANLQNEVAELSQKVSETTTSRQNEKEISQKCQVLDEDIDAKQKEIQSLKSQISALQKGYSKVLCQTLSERNSEITSLKNEGENLKRDNAITSGMVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKDQVQQFSGNSAVFTAGKAAGASGREGEAERGEARARGEAQSQNQATDGREGGKALEEYITQERNRAKETLEEERKRMQELESLLAQQKKALAKSITQEKNRVKEALEEEQTRVQELEERLARQKEVLESSIAH

SEQ ID NO: 154 - protein, 234 aa, Homo sapiens
MGGCVGAQHDSSGSLNENSEGTGVALGRNQPLKKEKPKWKSDYPMTDGQLRSKRDEFWDTAPAFEGRKEIWDALKAAAHAFESNDHELAQAIIDGANITLPHGALTECYDELGNRYQLPVYCLAPPINMIEEKSDIETLDIPEPPPNSGYECQLRLRLSTGKDLKLVVRSTDTVFHMKRRLHAAEGVEPGSQRWFFSGRPLTDKMKFEELKIPKDYVVQVIVSQPVQNPTPVEN

SEQ ID NO: 155 - protein, 490 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQSSILYKGAAAEGRPGGSLGVHPEGQQLLGMHVVQGPQVRQLEQQLGEAGSLQGPVLQHQSPKSPQQRLLELLHRSGILHARAVCGEDDSSEADSPSSSEEEPEVCEDLAGNAASP

SEQ ID NO: 156 - protein, 376 aa, Homo sapiens
MFNPHALDVPAVIFDNGSGLCKAGLSGEIGPRHVISSVLGHCKFNVPLARLNQKYFVGQEALYKYEALHLHYPIERGLVTGWDDMEKLWKHLFERELGVKPSQQPVLMTEPSLNPREIREKLAEMMFETFSVPGFYLSNHAVAALYASACVTGLVVDSGDGVTCTVPIFEGYSLPHAVTKLCMAGRDITEHLTRLLFASGFNFPCILNKAVVNNIKEKLCYIALEPEKELRKSRGEVLGAYRLPDGHVIHFGDELYQVPEVLFAPDQLGIHSPGLSKMVSSSIMKCDTDIQNKLYADIVLSGGTTLLPGLEERLMKEVEQLASKGTPIKITASPDRCFSAWIGASIMTSMSSFKQMWVTSADFKEYGTSVVQRRCF

SEQ ID NO: 157 - protein, 238 aa, Homo sapiens
MLLQPAPCAPSAGFPRPLAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 158 - protein, 211 aa, Homo sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 159 - protein, 436 aa, Homo sapiens
MPMSSLPAAILSHMTAINNVPPPPLHSIPNLKKSKHINYGQLNALCHIRGQHSRSMSNILSAHDTFMKQYPKVFLHQKPRLPKLFKQEEQRELNEGKEESQHQQPDDSNNIAVHVQRAHGGHILYRPKRATEKFEEFLAILKKLPIHRTPYEHKTVWKFLKTIPDLTFQLNDKHLKTLSKTVFSETWLKGSTVVANDGFYVILKGLARPQTNVYKNLIEGSDSPDSFISQSFHSFIWSEEFKNSTLAEMYLPSYDSMLSKWSTFGTLEVMPQNESETQMFSVVTEDDCEILKIPAKGYAKIKEEKIKLENMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFDA

SEQ ID NO: 160 - protein, 689 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 161 - protein, 261 aa, Homo sapiens
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 162 - protein, 780 aa, Homo sapiens
MEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 163 - protein, 145 aa, Homo sapiens
MAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 164 - protein, 698 aa, Homo sapiens
MQDDLLMDKSKTQPQPQQQQRQQQQPQPESSVSEAPSTPLSSETPKPEENSAVPALSPAAAPPAPNGPDKMQMESPLLPGLSFHQPPQQPPPPQEPAAPGASLSPSFGSTWSTGTTNAVEDSFFQGITPVNGTMLFQNFPHHVNPVFGGTFSPQIGLAQTQHHQQPPPPAPAPQPAQPAQPPQAQPPQQRRSPASPSQAPYAQRSAAAAYGHQPIMTSKPSSSSAVAAAAAAAAASSASSSWNTHQSVNAAWSAPSNPWGGLQAGRDPRRAVGVGVGVGVGVPSPLNPISPLKKPFSSNVIAPPKFPRAAPLTSKSWMEDNAFRTDNGNNLLPFQDRSRPYDTFNLHSLENSLMDMIRTDHEPLKGKHYPPSGPPMSFADIMWRNHFAGRMGINFHHPGTDNIMALNNAFLDDSHGDQALSSGLSSPTRCQNGERVERYSRKVFVGGLPPDIDEDEITASFRRFGPLVVDWPHKAESKSYFPPKGYAFLLFQEESSVQALIDACLEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHNDIDKRVEVKPYVLDDQMCDECQGTRCGGKFAPFFCANVTCLQYYCEYCWASIHSRAGREFHKPLVKEGGDRPRHVPFRWS

SEQ ID NO: 165 - protein, 60 aa, Homo sapiens
MSGRGKGGKGLGKGGAKRHRKVLRDNIQGITKPAIRRLARRGGVKRISGLIYEETRGVLK

SEQ ID NO: 166 - protein, 567 aa, Homo sapiens
MSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGDVFLENVIRDAVTYTEHAKRKTVTAMDVVYALKRQGRTLYGFGG

SEQ ID NO: 167 - protein, 2031 aa, Homo sapiens
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 168 - protein, 852 aa, Homo sapiens
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKIIKVQENPAAFVRAIQQYVDPDVQLVMCILPSNQKTYYDSIKKYLSSDCPVPSQCVLARTLNKQGMMMSIATKIAMQMTCKLGGELWAVEIPLKSLMVVGIDVCKDALSKDVMVVGCVASVNPRITRWFSRCILQRTMTDVADCLKVFMTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 169 - protein, 245 aa, Homo sapiens
KPKMLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 170 - protein, 508 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 171 - protein, 3477 aa, Homo sapiens
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRVRSPLQACENLAMNEGGPPTENNSLILEENKIPISPISPAFNECHGATCLPLSVRRSTTYSSLHASENRELLNVHSANVSKVSFNEKAVTETSFNSVNVNGQRGENSKLSLTPNCSSTLNITQSQIHFLSPDSFVNNSHGANNELELVTCLSSDMFMKDNSQPVHLESTIAHEIYQKILSPDSFIKDNYGLNQDLESESVNPILSPNQFLKDNMAYMCTSQQTCKVPLSNENSQVPQSPEDWRKSEVSPRIPECQGSKSPKAIFEELVEMKSNYYSFIKQNNPKFSAVQDISSHSHNKQPKRRPILSATVTKRKATCTRENQTEINKPKAKRCLNSAVGEHEKVINNQKEKEDFHSYLPIIDPILSKSKSYKNEVTPSSTTASVARKRKSDGSMEDANVRVAITEHTEVREIKRIHFSPSEPKTSAVKKTKNVTTPISKRISNREKLNLKKKTDLSIFRTPISKTNKRTKPIIAVAQSSLTFIKPLKTDIPRHPMPFAAKNMFYDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQGYWRRYSTRQRFLKLKYYSIILQSRIRMIIAVTSYKRYLWATVTIQRHWRAYLRRKQDQQRYEMLKSSTLIIQSMFRKWKQRKMQSQVKATVILQRAFREWHLRKQAKEENSAIIIQSWYRMHKELRKYIYIRSCVVIIQKRFRCFQAQKLYKRRKESILTIQKYYKAYLKGKIERTNYLQKRAAAIQLQAAFRRLKAHNLCRQIRAACVIQSYWRMRQDRVRFLNLKKTIIKFQAHVRKHQQRQKYKKMKKAAVIIQTHFRAYIFAMKVLASYQKTRSAVIVLQSAYRGMQARKMYIHILTSVIKIQSYYRAYVSKKEFLSLKNATIKLQSTVKMKQTRKQYLHLRAAALFIQQCYRSKKIAAQKREEYMQMRESCIKLQAFVRGYLVRKQMRLQRKAVISLQSYFRMRKARQYYLKMYKAIIVIQNYYHAYKAQVNQRKNFLQVKKAATCLQAAYRGYKVRQLIKQQSIAALKIQSAFRGYNKRVKYQSVLQSIIKIQRWYRAYKTLHDTRTHFLKTKAAVISLQSAYRGWKVRKQIRREHQAALKIQSAFRMAKAQKQFRLFKTAALVIQQNFRAWTAGRKQCMEYIELRHAVLVLQSMWKGKTLRRQLQRQHKCAIIIQSYYRMHVQQKKWKIMKKAALLIQKYYRAYSIGREQNHLYLKTKAAVVTLQSAYRGMKVRKRIKDCNKAAVTIQSKYRAYKTKKKYATYRASAIIIQRWYRGIKITNHQHKEYLNLKKTAIKIQSVYRGIRVRRHIQHMHRAATFIKAMFKMHQSRISYHTMRKAAIVIQVRCRAYYQGKMQREKYLTILKAVKVLQASFRGVRVRRTLRKMQTAATLIQSNYRRYRQQTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYQALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMYRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHLRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 172 - protein, 606 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTIGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 173 - protein, 528 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 174 - protein, 414 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVEAMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMQQGAATTVYCAAVPELEGLGGMYFNNCCRCMPSPEAQSEETARTLWALSERLIQERLGSQSG

SEQ ID NO: 175 - protein, 503 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 176 - protein, 631 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 177 - protein, 111 aa, Homo sapiens
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 178 - protein, 475 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 179 - protein, 890 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 180 - protein, 639 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQSPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 181 - protein, 341 aa, Homo sapiens
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMRDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 182 - protein, 366 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 183 - DNA, 2351 bp, Homo sapiens
cgggtctgatagtccctacctgtcaggactggtgttaggatgagataatgtttgtgaactgtaaactatataaacgtgtgctactgtgagaactggacaaagaagagagggagtgagagaaattaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgccgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaa

SEQ ID NO: 184 - DNA, 6834 bp, Homo sapiens
gccaggccgcgtccgccatagtacctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttc

SEQ ID NO: 185 - DNA, 1986 bp, Homo sapiens
aggcggagggggcggggcttcggccggctaagccgcggccacccgcggtctgagggaccggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaagatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcgacacttatcgtaatgttcctgcaaaattattgaacttctatagatggactgtggaaacaacgagcttcaatttgttgctgaagacagatgatgactgttacatagacctcgaagctgtatttaataggattgtccaaaagaatctggatgggcctaatttttggtggggaaatttcagactgaattgggcagttgaccgaaccggaaagtggcaggagttggagtacccgagccccgcttaccctgcctttgcatgtgggtcaggatatgtgatctccaaggacatcgtcaagtggctggcaagcaactcggggaggttaaagacctatcagggtgaagatgtaagcatgggcatctggatggctgccataggacctaaaagataccaggacagtctgtggctgtgtgagaagacctgtgagacaggaatgctgtcttctcctcagtattctccgtgggaactgacggaactgtggaaactgaaggaacggtgcggtgatccttgtcgatgtcaagcaagataacagggacttgaattagcagagtctaaaatcagggcaggcaaacgataatctgagtgcaagtctgaggagtcccagggtttagcagtagactgtatggtctttcaagagagttccagactggcactttcacccagaaccaatgcggtgtttcttaatgtttgcacaaatttccttaaaaatcaacttgtactgtagcataagaaaagtttttatttatctattggaagattatcagaaaaataccaagttatttt

SEQ ID NO: 186 - DNA, 6593 bp, Homo sapiens
agtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcg

SEQ ID NO: 187 - DNA, 1503 bp, Homo sapiens
gttggcaagcggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcctgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttg

SEQ ID NO: 188 - DNA, 4289 bp, Homo sapiens
gctggccccgccccctagcgccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacttgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccg

SEQ ID NO: 189 - DNA, 2212 bp, Homo sapiens
ggcgcgctttcaaacgctcaggtttcctaccttccggctgcttgggaacttctttcttgcccgccaagcccgcagccacccgggcgcggcgggactcctagacccggcgctgcgatgaagaggacccgcgacgaggtggatgcgacgctgcagatcgccaagctgaatgcggccgagctgctgccggcggtgcactgcctgggcttcggccctggggccagcggcgctgcagccggcgacttctgcctgctggagctggagcccacgctgtgccagcagctggaggatggacacagtcttgtgattcgtggtgataaagacgagcaagctgtgctgtgcagtaaagacaaaacatacgacttgaagatagcagacacttccaatatgttgcttttcattcctggttgtaaaactccggaccagttgaagaaggaagattcacactgtaacattattcacactgagatctttggtttttctaataattattgggaattaagaagacgtagacccaagttaaagaagctaaagaaacttttgatggaaaatccatatgaaggacctgacagtcaaaaagagaaggattcaaatagctcaaaatatacaactgaagatttgcttgatcaaattcaggcaagtgaggaagaaataatgacccaattacaagttctaaatgcctgtaagattggaggttattggaggattcttgaatttgattatgagatgaaacttctgaatcatgtaactcagcttgtggattctgaatcatggtcttttggtaaagttcctttgaacacatgccttcaggaactcggaccattggagccagaggaaatgatagaacactgtcttaaatgttatgggaagaaatatgtagatgaaggcgaagtttattttgagttggatgctgataaaatatgtagagcagcagcacgaatgctacttcagaatgcggtgaaattcaatctcgctgagtttcaagaagtgtggcagcagagtgttcctgaaggaatggtaactagtcttgatcagcttaagggtttagcgctggtggatagacactcgagaccagaaatcatatttttgctgaaagtagatgatttacctgaggataatcaggaacgttttaatagccttttctctctaagggagaagtggacagaagaagatattgctccatatattcaagatttgtgtggagagaagcaaaccataggtgcattactcactaaatattctcattcttcgatgcaaaatggtgttaaagtttataattcgagaagacccatttcttaaaagaacaacggtcttttcttcaggactcaagttgctttataaagttgctggatagaagaaaaataacttgtacttttatttctgacttttagaaacctagtcttctaaggcatttttctcctcatcttaagcattttgaaactactgttatttcttaaatgttataggatgtagctttaaaattatatttgtactatgtacacagtgtaaacaaggacaaaagaattctttcctatattatgtctgaggtctctatgatttatttaaagtttggctttttatatttaaaatgtcatttctttacttaggatttgatgttctaatcattaatacacttaagttttccagagaactaaatagtaatagtttcatagaagagaactatttattcacttaaatatcatttctcaagtgagtgagttcccctctacttttagccttccacccaaactggaagcctctaggtgctatcaattatttatatccatcgtttacatccatgaaattggctgaataattactcctctgcctggcgtagacatgcgctttgggaaaaaaacgagtttataatcctataatgaagaatactggcacaggcaatgctcactcgaaaacttcaagtaatttctagttggttttggaatgcttgataaagttcctttacagctttattttcctgatttgttttggtttagatcaaagttcaaattaattttaacttagctaatgaactcatcaccaggacagttggagggggtaggccgaggttaaatggtccacgtttcaaaaatgttaatggctaatccataattaaagaaggtttaactgttactgaagtttacaagttttattgtcatgaacatgaaatacaaacacgatggcttcgaaatgtctttcaataaatgtttctgcattt

SEQ ID NO: 190 - DNA, 2000 bp, Homo sapiens
gaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctttttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttt

SEQ ID NO: 191 - DNA, 1979 bp, Homo sapiens
tgcggggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcaggttaactccgttgactgccaaaatagcatccccaacgtgcagccctccgcatctatcagcaggttgccccggatggatctcagagatgaggattggaacaccatgttctttcccaccctaacaacaacaaagggcagtaaattaaagtactctttgtaaggtacagttaccgattaatctagagataaaatattttcttaaaaatatatttcattaaacacctatgctgtctct

SEQ ID NO: 192 - DNA, 5554 bp, Homo sapiens
ggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatt

SEQ ID NO: 193 - DNA, 2740 bp, Homo sapiens
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 194 - DNA, 8682 bp, Homo sapiens
gaggctttgcggtggctgcttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagctggcagtctacgccacgaggaagacccgtagcgtcaggagccaggaggaccagtggtacttgggctacccgggggaccagtggtcttcgggcttctcctacagctggtggaaaaatagcgtcggcagcgagagcaagcacggtgagggcgccttagaccagccccagcacgacgtccgcctggaagatcttggcgagctccacagagctgcccggtcgggcgacgtccctggggtggagcacgtcttggctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttggtgataaaagtccatctgtatcaccatcaatgcctgaaaatcagtcagcaaccaaagaactgggacagatgaacttaacagaacgagaaaaaatggacactggagttgtacttctctcagggaatgatactctccatgacctgtgccaatcacagctaccagaaaacaaagagagcaaagaagcagaacaagacttggagctgacatcagaggaagagcaagaaagacttaaaggatgcgaaaataagcagccacagaaaacgtctcaagaaccagaaatggctaaggattgtgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccgtactctgggtcccaggaacatgtttgccagtcatcttctaagcttcatttacatgaaaataaattagactgcgacaatgataacaaactaggcattggacatatttttagtacagataacaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacaggcctgcagataaaacagctaatgaaaagaacaaggtcaaaaaccaaatatatcctgaggctgactttgctgactcaatggagccatctgaaatagcctcagaggattgtgaattgtctcactctgtttatgagaattttatgttgctggaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacaagtaaacaaaaggaactagaaatggctcaaaagaaaatgaattctgagatttctcataggcatcagaaagaaaagcatctctttcatgaaaattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactggctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatacgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtgaaggtgaacggcataaactgttgattgaagaaagagcaaggaaggagatacaagaaaaattaaacgaagccgttctcaccttgcagaaacaagcagcagtatctcatgaacagttagcacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtaaaagttagagaatccttgtcaaatgaactcagtagaactaatgagatgatagcagaggtcagtacgcaacttactgtggagaaagagcagaccagatccagatctctattcactgcttatgctacaaggccagtcctaagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagagtatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatgtagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagcttcccccctgtgggccatttgagagtaaattgctgacattatgccatcacatctggtatgtgggtattcccacaagtcaggacattttatataactacttcataatcagaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaatagtagcccagcatccattagctgttcttcacgatgctctcccttctctcacccgccaccatcccacatgcccctgtgtgtgttgttccccgccatgtgtccatgtgttgtcattattcagctcccacttgtaagtgagagcatgcagtatttcattttctatttctgtgttggtttgctgaggataatgttctgcagctccacccatgtccctgcaaaggacatgtctcattccttttcatggctgcatagtattccatggtgtatatgtaccacattttctttatccagtttatcattgatgggcttttaggttgattctttgtctttgctgttgtgaatagtgctgcaatgaacatacgtgtgtgtgtatctttatactagaattagttatattcctttgggtatacaccaagtaatgggattgctgggttaaatggtatttcaggttctagatctttgaggaatcaccacactgtcttccacactggttgaactaatttacactcctatcaacggtgtaaaagcattcctgtttctccataatcttgccagcatcttttcagttttttgaattatagccattctgactgttgtgagatggtgtcttgttgtggttttgatttgcatttctcagatgatcagtgatgttgaggtttttttgtttgttggctgcatgtatgccttcttttgaaaagtgtctgtttgtgtcctttgaccactttctaatggggttgagttttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttctttcaggatttttatagttttgggttgtagatttaagtctttaatccatcttgagttaacttttgtatatgggttaaggaaggggtccagtttcaatttgctgcatatggctagccagttctcccagcaccatttattaaatagggaatcttttccccattgcttccttttgtcaggtttgtcaaagatcacatggttgtaggtgtgtggtcttatttctgggttctctattctgttccattggtctatgtgtcggttcttgtaccagcaccatgctgttttggttactgtagtcttgtagtatattttgaagctgggtagcatgatgcctctagctttgctcttcttgcttaggattgtcttggctatttgggctctgttttggttccatatgaattttaaaatagctttttctaggtctgtaaagaaggtcaatagtagtttaatgggcctagcatttaatttacagattgctttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgatttttctctcggcttgcctgttgttggtgtataggaatgctagtgacttttgcacattgattttgtatcctgagactttgttgaagttgcttatcagctaagaggtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagagagggcatctttgtcttgtgtcagttttcaagggaacgcttccaggttttcaggtactcaggcaacaaatagcgctacgaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcactaggcagatcaccaagacagaaagtcaacaaagaaacaatggacttaaactataccctagaacaaatggacttaacagatacttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccgaaaggaacactcaaaagcatgcaaatacatggtaattaaataacctactcctgaatgattgttgggtcaacaatgatatcaagagggaaatttaaaaattctttgaactgaacgataatagtgacacagcctatcaaaaactctgggatacagcaaaagtggaggtaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatg

SEQ ID NO: 195 - DNA, 1436 bp, Homo sapiens
tttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtg

SEQ ID NO: 196 - DNA, 1490 bp, Homo sapiens
gctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggactcaaggagcatgtcaaatcccacaagcatgaaggagaaaagctttctctaccccggcatctcaaagtagtgggccagattgagcacctagtgatcacactgggctccctccgcctggactgcccagcagctgtggttgatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaacacttcagaagcataactacagcctgcagcatgtctgcacgtgtgcatgcatacacaccgggttgacagatagagaaaactgggtttgaaccaaatgccgtagtgacttgctgtggaccaagtccttccatctaatagaagctccaggggctccttcccattcagacctctctagactatagtctatgcttagagatcttgtctggttatggccattgttttttactactttgatcacttaacttatagaccttttttgacactgccagtctcacttgtggcctatttctctgcttcttccaggaatttgcttttattagtcaagtataggggctgccaggttctgtgtctccatagatatatgtgcttcttttcctatagctaaatgtataataaacaggaacctgacctttacctcctttcagctgtttcaaacaggtgccaggatacctatgtcttagaattagagtttcttcaaattgattcattgatttctcaagtatggattatgtgaaagagcccagggacattatccattacagtttaactctttcatttaaaggtccagagaggcaagtgaattgtctaagttcatatattaggtcagtgactgaagggaccaagaacgcagacctgatttccaagccaagactcccatgctgcctcatttgtattcaagcctttaacaggagggcaaagaggtgagaatgtgtt

SEQ ID NO: 197 - DNA, 3738 bp, Homo sapiens
ctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctac

SEQ ID NO: 198 - DNA, 8287 bp, Homo sapiens
gcgcccaggagcagagccgcgctcgctccactcagctcccagctcccaggactccgctggctcctcgcaagtcctgccgcccagcccgccgggatgcagtccgggccgcggcccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggacattatgaagctttctccaccctggcccctgaggcttggccagccatggagctgcctgagccatgcgtgcctgagccagggctgcctcctgtctttgccaatttcacccagctgctgactatcagcccactggtggtggccgaggggggcacagcctggcttgagtggaggcatgtgcagcccacgctggacctgatggaggctgagctgcgcaaatcccaggtgctgttcagcgtgacccgaggggcacgccatggcgagctcgagctggacatcccgggagcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccaccgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcagggggcaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagcacgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacagctagtccgggctggtcagccagccacagccttctcccagcaggacctgctggatggggccgttctctatagccacaatggcagcctcagcccccgcgacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggagccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccct

SEQ ID NO: 199 - DNA, 2505 bp, Homo sapiens
gccgtccttacccccaggactcggccccatggagacgccgccggccgccgctggcgcatggcggggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctc

SEQ ID NO: 200 - DNA, 2451 bp, Homo sapiens
atggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttag

SEQ ID NO: 201 - DNA, 1949 bp, Homo sapiens
atgacgcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgc

SEQ ID NO: 202 - DNA, 1375 bp, Homo sapiens
cggtggcggtggcggcggcggcggcggcgcgtggcaggtccggcgggcgcgaggcggcggcggaggcccgagcccggcccagcctcgtcccgcccggagcccgcctggctgctaccccgaccccggctccggtcccgtcctgtcccggcgcgccgcggcctcgccccggcccccgctcggcgcctcccgagggagcggcgctgccggccgagagcgcaggcccggccatgaccgacttcaaattgggtatcgtgcggctcggccgggtggccgggaagaccaaatacacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtgggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatc

SEQ ID NO: 203 - DNA, 3950 bp, Homo sapiens
cggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgacaacgtggatctgggagagctgatgttttccctgtgctatcttccaacggctggcaggctgaccattaccattataaaagcaaggaatttaaaggcaatggacataacaggagcatcagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccgtgtaggtcacaatgagatcatcggcgtgtgtcaagtaggcaacgaggctgagaggctgggcagagaccactggagtgaaatgttgtcatatcctcggaagcccattgcacactggcattccctggtggagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttg

SEQ ID NO: 204 - DNA, 2362 bp, Homo sapiens
cgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgtttt

SEQ ID NO: 205 - DNA, 3955 bp, Homo sapiens
gggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaaggaggtgttcaaggagtgcttcacattcccaagaaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctg

SEQ ID NO: 206 - DNA, 2200 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttt

SEQ ID NO: 207 - DNA, 3047 bp, Homo sapiens
cacccgaaggcgtccgggaatcttcactttttccgttgctagcagtggaagggtcacagaccaaacactaaggcctgagcggtgacaaccgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttataaaa

SEQ ID NO: 208 - DNA, 1013 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 209 - DNA, 1144 bp, Homo sapiens
cgcctgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttct

SEQ ID NO: 210 - DNA, 1701 bp, Homo sapiens
atggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtga

SEQ ID NO: 211 - DNA, 1865 bp, Homo sapiens
aaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctctt

SEQ ID NO: 212 - DNA, 2380 bp, Homo sapiens
tcggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttaggtaagttatagtccttaccattgggtctaaggcagtttccaggaaagcatggcaactcgttcagctatgtaagttgaactctgtaccacttgggagggaacattcccctagatgacaatgtcagtggcactcgaagttgtgcagtgcacattcttatctaccaacatatacagcagtccttctgggaaggaaatttgggcaggaaagggaactcacagtgtcggaatgcctggagcatttcttctagtctggtggacagaatatgaaagtatctgcctggcagtgcagtaaatgaaaagag

SEQ ID NO: 213 - DNA, 1530 bp, Homo sapiens
aggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 214 - DNA, 615 bp, Homo sapiens
gaaacaacaacagcatttggtttgctctacacccctgtcacccctcgcccgcaagcccagggagtggtcagcagtggggctttgtgatgtgaagccaccctagggctgccattggctgggacactgcctgtatgatcaaacaaagctcaagggtgtggctttgccttgtcaccaggagggtatatacagggagggcaagagctccgggccactgcgaagattcaaaacctacaaaagcctgccgcagacattgaagaaccaatatatacaatggacaaacaatccagtgccggcggggtgaagaggagcgtcccctgtgaatccaacgaggtgaatgagacgatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagc

SEQ ID NO: 215 - DNA, 378 bp, Homo sapiens
gaggatgtccttaagttccttgcagcaggaacccacttaggtagcaccaatcttgacttccagatggaacagtacatctataaaaggaaaagtgatggcatctatatcataaatctgaagaggacctgggagaagcttctggcagcttgtgctgttgttgccattgaaaaccctgctcatgtcagtgttaaatcctccaggaatactggccagagggctgtgctgaagtttgctgctgccactggagccactccaattgctggccgcttcactcctggaaccttcactaacgagatccaggcagccttctgggagccacggcttcttgtggttactgatcccagggctgaccaccagcctctcacagaggcatcttaa

SEQ ID NO: 216 - DNA, 3657 bp, Homo sapiens
tcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttggatgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggtt

SEQ ID NO: 217 - DNA, 3309 bp, Homo sapiens
gatgcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcagcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattgg

SEQ ID NO: 218 - DNA, 1441 bp, Homo sapiens
gccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttt

SEQ ID NO: 219 - DNA, 1182 bp, Homo sapiens
gcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaggccctttaatcctt

SEQ ID NO: 220 - DNA, 495 bp, Homo sapiens
atgtccaaagcccttgatgtcctacaaatgaaagaggaggatgttcttaagttttttgctgcaggaacccatttaggtggcaacaaccttgacttcaaaatggaacagtacatcaatgagaggaaaagtcatggcatctacatcataaatatgaggaggacctgggagaagcttctgctagcagcttgtgtctttgctgccactgaaaactctgctgatgtcagtgtcatatcctccaagagtactagccaatgggccttgttaaagtttgctgctaccattgaagctactcctattacttgctgcttcactgaaaacatcactaaccagatccagatggtcttttggaagccatgggttctgattgttactgagcccagggttgacctccatcctctcatagaggcatcttatggtaacctgcctaccattggtttgtgtcacagattctcctctgcactatgtggatattgccatcccatgcaacaacaaggg

SEQ ID NO: 221 - DNA, 1523 bp, Homo sapiens
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttc

SEQ ID NO: 222 - DNA, 2209 bp, Homo sapiens
agcagacaagatggcttccgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaagttgcacaagggaggttataatggacttaaccaatgtttaccaactatgcagagcaaaatgtttcaatgtgataaatatgtgaaagtctttaataaattttcacattcagatagacataagataaaacatatggaaaataaacctttcaaatgtaaagaatgtggcagatcattttgcatgctttcacacctaactcgacatgaaagaaattataccaaggtgaatttctgcaaatgtgaagaatgtgaaaaagctgttaaccaatcttcaaagcttactaaacataaaagaatttatacttgtgagaaactctacaaatgtcaagaatgtgacagaacttttaaccaattctcaaaccttactgaatataaaaaagattatgctcgagagaaaccatacaaatgtgaagaatgtggcaaagcctttaaccagtcctcacaccttactacacataagataattcatacaggagagaaaccctacaaatgtgaagaatgtggcaaagcctttaaccagttctcaaatcttactacacataaaaaaattcatactggagagcaaccctacatatgtgaagaatgtggcaaggcttttacccaatcctcaacccttactacacataagagaattcatactggagaaaaaccctacaaatgtgaagaatgtggaaaagcttttaaccgatcctcaaaacttactgaacataaaaacattcatactggagagcaaccctacaaatgtgaggaatgcggcaaagcttttaaccgatcctcaaatcttacggaacataggaaaattcataccgaagagaaaccctacaaatgtaaagaatgtggcaaagcttttaaacactcctcagcccttactacacataagagaattcacactggagagaaaccctacaaatgtgaagaatgtggcaaagcttttaaccgatcctcaaaacttactgaacataagaaacttcatactggaaagaaaccctacaaatgtgaagaatgtggcaaagcttttatccaatcctcaaaacttactgaacataagaaaattcattctggagagataccctacaagtgtgaagaatgtggcaaagcttttaaacactcctcatcccttactacacataaaagaattcatactggggagaaaccctacaaatgtgaagaatgtggcaaagcttttagccgatcctcaaaacttactgaacataagataattcatactggagagaaaccctataaatgtgagagatgtgacaaagcttttaaccaatctgcaaaccttactaaacataaaaaaatacatactggagagaaactacagaactggaatgtgtgataatgattttgacaacacctcaaatttttctaaatataaaggaaatcatactggtgaaaaattctagaaatgtaaagaatgtgtcaaagactttaaatggttttcacacttcattgtatgtaagataattcatactggagaaaactacaagtgtgaagaatttggcaatactgttaattaaggctcaaaccttattgcacaggaaagcgtttatacttaagaaaaattgtacaaatataaagagtgtaaaatagccattaatatctgttgacatcttaatatcagaatgttggtacttaataaaagcattataaatgcaa

SEQ ID NO: 223 - DNA, 1632 bp, Homo sapiens
agggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattat

SEQ ID NO: 224 - DNA, 7915 bp, Homo sapiens
ccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggacgaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttatagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggttctgtttgta

SEQ ID NO: 225 - DNA, 7978 bp, Homo sapiens
caggagcttaccaggctggcttgctctgagctgcggttactgtgtccaggccccgggttctcagaactgtcatacataaagtacacagaaatgaagagaaaagtcgtgaatactcacaagctgagattgagtcctaatgaggaagccttcattttgaaggaagattatgaaagaaggcgaaaactaagattgctacaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgaacctgatttggatgctttggcacagcgggcagcagaaaggaaaagaaaagcagatttgaggcataaagaagccttgaaagtacagaaaaatcaaaaagaaatattactgaaacaaaaaacctggcatataaaagctcgaaaggaagcactgcttgtggaaaaagagagatcagccaaaattacaagtctgccacctcctcctccaactctttttgagaacatcgaagtaaaaagaatttctgcagtcaaaaccaatagttctacctaccatcatcttcacacttttgtgaatagagagacagacacaaaacggccagatgctcgtttggctgctgaagaggaagctaaacgattggaagaactacaaaaacaggcagcacaagagagaatggaacggtttgaaaaggcacatgtacggggattccaagcaatgaagaagatccatttggctcaaaatcaggagaaactaatgaaagaactcaaacagctacagcaagaggacctggcacgtaggagacagactgtagcacaaatgccaccacaactagttgaacttccatacaaacgcagtgaaatgaaagaagactggcagagagaattggaatttgcctttgaagatatgtacaatgcagacaggaaggtgaaagggaatctgattctgcaccttgaaccagagcccttgcccactgtgactaatcagatccaagatgaagagctggacctttcaatggaacaagaaaatttgggtgcagctgaagaccttccagtgacagaagctgaaatatgttctagtgaaacagatgttcccttggtaatgaagacccaacagattccttcaaaagttctttttaaaaaattattaaataagatccgaagccaaaaatctctctggacaattaaatctatgtctgaggatgaaagtgaaatgattacgactgttagtgaaattgagagtaaagcaccaacggttgagtcaggaacaattgccagcaaagagagaacgttatcctctgggcaggaacaagttgttgaaagtgatacactaacaattgagtctggaccacttgctagtgaagataaaccactttcgtgtggtacaaactctggaaaagaacaagaaataaatgagactctgcctatcacaactgtagctcagagttcagttctacttcatcctcaagaagcagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgttgttgaaaatcatgcagtgttaagttatgctgtggaggaagaacatgcatatttgggtccaactgtgaagccagatgataaggctaaaacactgtcttatgaaccattatcttcagcaactgtttccactgggagccttttaagttatgaaaacacagatttgagccttacagatccagagtcattttcagagcacatggatgatagcaagcaagaatctaccaccagtaaagaagaggaaacaaatattataagttccatagttccttcaacacaagattcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgagg

SEQ ID NO: 226 - DNA, 2346 bp, Homo sapiens
cggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatttc

SEQ ID NO: 227 - DNA, 1691 bp, Homo sapiens
aggggcgggcagccaggggcacttccgctggcccaagtgatctgcatgtggcagggctgcgcagtggagcggccagtgggcaggatgacgagccagacccctctgccccagtccccccggcccaggcggccaacgatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtgatcctcaggagcagagactgttatgaattctggcgtggcttatgaaattaaaagttgccatcaaagccattttcttttaatttcacaaacatcaggcaatttccagggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaagatgtagtctacatagccccagcttggggtccaatccatctgtccctggcatgtgccttcatgtagtaggtgctttcctgatcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgaga

SEQ ID NO: 228 - DNA, 1657 bp, Homo sapiens
actgttgagcaggcctctctgcctgtggccttccggccggtttccagacgcccaggtggccaacattagagtccgcgtagcagtgtgagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctc

SEQ ID NO: 229 - DNA, 2128 bp, Homo sapiens
gatcaagcgccttcctttcccttcctctccccacttggcctttgccctaagccaagacctggccatcagcctggctgcaggggcctgcagagccagctgcactttttcaggtatgggggagggccaggcaccatgaagccagtgtgggtcgccacccttctgtggatgctactgctggtgcccaggctgggggccgcccggaaggggtccccagaagaggcctccttctactatggaaccttccctcttggcttctcctggggcgtgggcagttctgcctaccagacggagggcgcctgggaccaggacgggaaagggcctagcatctgggacgtcttcacacacagtgggaaggggaaagtgcttgggaatgagacggcagatgtagcctgtgacggctactacaaggtccaggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaagcctggcattcttataacaccacgtggcgcagcaagcagcaaggtctggtgggaatttcattgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcccttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaattaaaaaaaaaaacacttgtaatctcacccctcctaaagttaatgttaagattttgctgtatataatgaatgtatattatgaattatttacaaaaatggcatcatagtatacaaa

SEQ ID NO: 230 - DNA, 2570 bp, Homo sapiens
taatcgtattcagcatgttttgcacaagaaatgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaatttt

SEQ ID NO: 231 - DNA, 1915 bp, Homo sapiens
cactaaggcgcaaggcagctgcacatccacggccagcctcgttgtcttcagggatttgttcaaagttcattctgaattgtaaggtaaccactgcagaacacgagcctttcctgggtatgtgtggttatttctgcccttcacggtcccactcaagtcctgcctccctcagggagacctcccagacctcaccaagccgtgggcacgtggaccagaagccgtggaccccagaggctcatttagggatctgctttctgaacccaggtcctaacatctgcactgcagcgagcatttctggtgcctcaagtgagtcactccaacttccagctcactgagaggcgatggagcactgagtgccagcatcttccagcaccagaggagctgactctgaatagacagctcggcagcggcctcagcacagagcaggggagccaccagccacaggcagccactgagcccttggcatgtaacccggtaacccatgcaacagaagacctgagcgtccagtgttgctagcttgaagtaacttcagtggtgttccccagcgtttttctcatccccctcccttcccttcccctacagctttcttcctctttcccctccttctgagtcttttgtccccagtcctgggaaccttttttctgacttggtgttttctcctgaatgcctccttcctggccccctaatcagaaatgcagaagccacctgccccacacagggggccgctttccctgcatctggcactcaccaggacagtcatagaactggccttgggtgcttggggagagtggagaggtctggggggcatccactggcctcagcctcagagcttctcatcagtaacccaggaggcaaaggcccagctcgagattagcccaggccactgtatctgtgccaagacctacagctgtccctgcagggcgtgcatctcctgcagcccaggctatcacaatggtgtcccttttggtggggatgtgaggcctgctgcctgcctgggaagaagctgacaggattgttggtgctgtggggagaagctggtgtaactgagacccatgagggaggccctttgtgggtctgtggctgggaggagctctggggaagatgggccttgagaaatcccagcttagcacctttgacagttgctccactgagtcaccctagactgcaatctcacagatgttctaaccaccctctccctggggagcccttgggggtgctgcaagcccagtcctcactcactggctttgtgcttctcttcccgacttcctttttttgctcctgttgagaaatgtgggtccagggctgcgtgctccagtgtgcggaaggaagggcagcgtgctctttggactgagctggctcaagggaagctgggtctgaggggagactgacctcgacccttcttaaatgaaacaccttttccctgcgtctcagtcaccagttacctggcctgatcactgtgtgccacaccccatcacatccatccccacaagaatgccaggaggaggggtcattggcctttttgccagcacaaacctctggaggccagctcccaagacccgccaggcacacctgccagagtgccttaacttgggatgtctgcaaacctctgtccatggccgaacccaccccactgcctgttactgtaaataaaggtctattagcatgccaccatgcccctcctccgatgcatacagtgcccagctcagcacctggtgcaaagtaagcacaatctggcttccagccatcactgctgttgctactatcacaaatattaggccccttctagaatgcaaagataacccagggctgctcgttctgtgtccagatcacagagtttttctttttatccttatcaactttattgagggataatttacaggcaataaatcatatccatttaaaaaaaaaaaaaaaaaaa

SEQ ID NO: 232 - DNA, 6467 bp, Homo sapiens
ggggggagtcggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtt

SEQ ID NO: 233 - DNA, 3399 bp, Homo sapiens
gctggggctcggggctcggctctgggagagctcgggcgggagcccagagagagccgcacggggacctcaagccagaccccagcgttcagccgccacctcggcccgggcccgccccgccccggccccgcccctttcctgcccgccccaccccctctacgcccctccacccggaccccgccccctgggcagccccccgccctctccgcccgggctccgccccctccccctggccctcgccaccggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgt

SEQ ID NO: 234 - DNA, 3939 bp, Homo sapiens
tttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttcc

SEQ ID NO: 235 - DNA, 6855 bp, Homo sapiens
ggtacagcccgcgccgcctctgctgcagccgctgccgtctactccttgcgcgctggcactccgcagcctttaaggttcgcgcgggggccaggcaagagttagccatgaagagcctcaagtcccgcctgaggaggcaggacgtgcccggccccgcgtcgtctggcgccgccgccgccagcgcgcatgcagcagattggaataaatatgatgaccgattgatgaaagcagcagaaaggggggatgtagaaaaagtgacctcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatacgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactttgccctggattgactacatatttttaaaccttcaagtccctaataaaacatgagccatctgagtgagtccatatgaagcgaggttaggctgaaataattgcttaaagatgtctttcagagaaattaatttggttggtggccacttttaggtggatcaaaagacctttcagatcctcagaaccttgagacataatacagttgtgaggaatgtgttgtaacttggctggccaagttacatgttacagtatctttactgaggtaacttcattagtgtctttggccttttttgtaggtatagatattttttctttttacactaataacttttatgccttttaaaataaatttattttcataaatggtttgcagtgctaaattacatttagattaagaacaggcaggggtggaatatatcaggaatttataataaaattgccttaatctctacaacagtatcttaatttttacttgcggtgactattcttgccacaatattggagaataatgatagatgatatactagatttttcaaagtgtgaaaacctttagactttttttagcaattagtttgacattcgctactatagtaaccaagcactcattatatatgcatcctccaaatgtttcatgcttatttataggaaagttatattaatgagattaataatgtgaaatacagttttcctgcaaaattagcattagagaattgattttagataacagatttttaaagttttagagaaaagtacagtaatacagtaaactgaaagagtatatagatagcaataaaataacataagtggacatgtttatagtaaatactctgaagtaaacaaccgtttttattaactgcatctcattagggaaagtttatatgtcttgttattttttattaacattttatttaccattcagagtgaaaattactaatttgagtattaacaaataactgaataaatggatcattacagttaggttttctcaaattgcaaaatttgccttagcaattatctttgaacatcccgaaccagatttttaaatcccatttttgtttaatagggtaaaaataccatcaaaatgacttctcataccaaagaataagccatcatattttttcggtgttgaaacaacattgaaagtcagaattggatttgtttttaattctttatacggtttacataagcaatatctgtctctttaattattatgattaatgtcgtccttcagcatgagttctgtttcacaagttttgggccacctatttcaataaaaaataaaatataaattaaaaaagttgccgggggtggtggctcatgcctgtaatcccagcactttgggaggctgagggaggtagatcacctgaggtcagaagttcgagaccagccttaccaatatggtgaagccccatctctactaaaaatacaaaaattagccctgcatggtggcaggtgcctgtagtcccaggtactcgggaggctgagacaggagaatcgcttgaacctgggaggcggaggttgcagtgagccaagatctcgccactgcactccagcttgggcaatagcaagactccatctcaaaataaaataaaataaaacttagagcaaagtttaaaactgagtattcatattaagtgttttattttccatattagagatgggaagggaaccttatgtgtattttattttgttttcaaccatcaataaagttttctctagaatattgttttgaacatccttgtaaaagatttgcgagttaaactattttatttactgtctgtgagagcattgggagtaggaaacgatggactccaaagtacaagggagaatacccattttcattcagctatctggagtaaaatatcaagtacttccttcaactaatcttgtctcattcactcaccttttgatatcgaaggcagaaattgcgtttacaacactgaagaccaaagctttttaattagtaaacaagcggaacatagataatggacaatgctggccactgccattctgtgttcagaaagactatgagacctgaacatatggccaagaggaaagaagagtgacgttgtctaagatgtaatgagtgctctctgagagaatcactcaattcctattggagtgcaatccttacttgagaactttattactcttgttctgtgtagttttttttttttgtcacttccccatcagaaaagcatattctttttgatagagggtcagtgttataaataattgtcttttgaaataaaatcaaatattcatgcattg

SEQ ID NO: 236 - DNA, 1239 bp, Homo sapiens
agtctgagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctctatgaatgagaa

SEQ ID NO: 237 - DNA, 2337 bp, Homo sapiens
atggctcgcacagggtggaccagccccattcccctatgtgtttctctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagcttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactgccatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctattt

SEQ ID NO: 238 - DNA, 3646 bp, Homo sapiens
ccggagctggacgtgggcggcggcggggcctgaggtctggggctcgggcggtgggcgctgctgtggccggcgcgcgtgggccccggcgaggcggcactgcaggagctttgcgggcagctggagcgctacctgggcgcggcggcccacggctgtggctgcgccaccgtgcgcgacgctctcttcgcggctaacggccgcgcggccgactgcgagagcccgcgcgagtttcgggagcgggccctgcgcgcctgatgggtcgaggcggacgcgcggctgcgtcaggtaagcgaggccgggccgccggcgtttgaccgcgcttgggtggcctgggacccggtgggaggcttccccggcgccgagagccctggctgacggctgatggggaggagccggcgggcggagaaggccacgggctccccagtaccctcacctgcgcgggatcgctgcgggaaaccagcgggagcttcggcagggcctgcagagaggacaagcgaagttagagcctagtgtacttgccgctgggagctgggctaggcccccaacctttgccctgaagatgctggcagagcaggatgttgtaacgggaaatgccagaaatactgcaagcaaaactgaaaacaacccatccatgtaggaaagaataacacggactacacgttattcaaggacaccgaaaagccaacaccatggtagcattaatgaaagtttaccaagaggaagatgaagcctaccaggaattagttaccgtggcaaccacgttcttccagtacttactgcagccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggagtttctgatatattgcacagaatcaacaagatataaagcagaatgatgatcctggttttttggtcaaactatccatatgagcctgtctgtctagctagtcatagaaacaatatggaagcaagtgtgccaaaatataagaagcacttgcctcaactaggaatgcagaaagaaatggaacaggatgtgaagagatttggccaggctgcctgggccacagcaattcccaggttggaaaaacttaagctaatgctagctcaagagactctgcaactcatgagagcgaaagagttatgtttaaatcacaaaagagctgaaattcagggaaagatggaagatcttccagaacaagaaaaaaatataaatgttgtagatgaattagcaatacaattttatgaaattcagttagaactatatgaagttaaatttgagatattaaaaaacaaagaaatactgcttactacacagttggactctcttgaaagacttataaaagatgaaatttagaatcaagttcaaaacaaaaaactctttggaattttgattgtgattttgcttaaaattagagattactttggggagaatagtggtctttgcaattttgaatcttcctacccaagaacatgaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcgaagaaaatcattggctcagattgcaacaggctgaagaaagcataagatattctcgtcagcatcacagtattcagatgaaaagagacaagataaaaaggagcaaaagaaaaaagaatggatcaaccaagaacgtcaaacactccaacaattgagagcatttaaagatagaaataatgagagagattgtctgtcttgaagttctcagtgcctgtgcattgctgccactacacagctagtatcatgacagcagcttcagaaccagagctggcttccaggcaaggctgggtggggaagaaagagaaaaacaaaagaattatttctctatgccgagaccagctcggtcagggagaccctaacctagcggtgctagaggaattaaagacatagacacagaaatatagaggtgtgaagtgggaaatcaggggtctcacagccttcagagctcagccacgaacagagatttacccacgtatttattaacagcaagccagtcattagcattgtttctatagatattaaattaactaaacgtatcccttatgggaaacgaagggaggggccgaattaaaggaataggttgggctagttaactgcagcaggagcatgtccttaaggcacagatcgctcatgctattgtttgtggcttaagaatgcctttaagcggttttccaccccgggcaggccaggtgttccttgccctcattccagtaaacccacaaccttccagcatgggtgttagggccattatgaacatgttacagtgctgcagagattttatttatggccagtttatggccagattttggggggcctgctcccaacactctacatatgctccatcttgcagaggcttcattcttggttctctagctaaaaacagtagaaattttgcacacctgggttagaaaaaaaaatagccattaaacccacccctgttacaggtcactattggtattttgattttgccttcaatccatctgttattgtttacttttaagagtccttgatagttgctttttatgtccagagttttaatttcagtcagaaagagaaataggccttggtgagcatgctttgtcttggctggtgccagaagtctgtactcaaatatttttaaaataatttttagttgaataacaagttagacctgtgtttagctttctcattgttttcctaaaaatagaagaaaaggttttaaatactttaaccacgaaatactttaaagcaggtttaaaataaactccttcattttgcctgttctattactctgttctcacactgctaataaagacatacccaagactggtaatttataaagtaaagaggtttaattgactcacagttccacatggctggggaggcctcccaatcatggcagaaggtgaatgaggagcaaagtcacatctttgtggcaggcaagagagagagcatgtgtgcaggggaattcccctttataaaaccgtccaatctcatgagacttatgcactctcatgggagcagcatgagaaagactcacctccgtgattcagttacctcccactgtgtccctgccacaacatgtgggaattgtgggagctaaaaatcaagatgagatttgggtaggaacacagtcaaaccatatctcctgtatacattcacactagcattttagttttagaactagttctatgttactatctgaattaatttttccacaattttgtaaggaaaaataatgcgttctttgaatttcatgtgtaaatgatatttttagttttgtgtcattttgtccaataaattctgaaaatctttgtattgacagtgtgttatctctgcataaccatatatgtataagagcgctcaataaaaagaataaagagg

SEQ ID NO: 239 - DNA, 2221 bp, Homo sapiens
ggccgggccgccggcgtttgaccgcgcttgggtggcctgggaccctgtgggaggcttccccggcgccgagagccctggctgacggctgatggggaggagccggcgggcggagaaggccacgggctccccagtaccctcacctgcgcgggatcgctgcgggaaaccagggggagcttcggcagggcctgcagagaggacaagcgaagttaagagcctagtgtacttgccgctgggagctgggctaggcccccaacctttgccctgaagatgctggcagagcaggatgttgtaacgggaaatgtcagaaatactgcaagcaaactgaaaacaacccatccatgtaggttattcaaggacacggaaaagccaacaccatggtagcattaatgaaagtttaccaagaggaagatgaagcctaccaggaattagttaccgtggcaaccacgttcttccagtacttattgcggccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggagtttctgatatattgcacagaatcaacaagatataaagcagaatgatgatcctggttttttggtcaaactatccatatgagcctgtctgtctagctagtcatagaaacaatatggaagcaagtgtgccaaaatataagaagcagttgcctcaactaggaatgcaaaaagaaatggaacaggatgtgaagagacttggccaggctgcctgggccacagcaattcccaggttggaaaaacttaagctaatgctagctcaagagactctgcaactcatgagagcgaaagaattgtatttaaattgcaaaagagctgaaattcagggaaagatggaagatcttccagaacaagaaaaaaatataaatgttgtagatgaattagaaatacaattttatgaaattcagttagaactatatgaagttaaatttgagatattaaaaaacaaagaaatactgcttactacacagttggactctcttgaaagacttataaaagttaaaccttagattgacttgggtctgtttctgagttgttctcctccattggttcgtgagtggcttctgctgctggctccatactgttcccacgactgtcttggaggcacattttagggtctgaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtaggaaggatcagtgcaaagaaaatcattggctcagattgcaacaggctgaagaaagcataagatattctcgtcagcatcacagtattcagatgaaaagagacaagataaaaaggagcaaaagaaaaaagaatgggtcaaccaagaacgtcaaacactccaacgattgagagcatttaaagatagaaataatgagagagattgtctctcttgaagttctcagtgcctgtgcattgctgccactacacagctagtatcatgacagcagcttcagaaccagagctggcttccaggttgtgtgtgtgagccagattttattgcaagtgtttgaaagactattgcaaatatcggatattgccagacagttggtaaaaagcaaattgagtctattgagaaattaattcaccagctgaaggaagcacatttgccttacagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttttttcattctgccctcactttgttggtttctcagttttacagatgcagtgtcatgcgcagaaccctgtaaatgagcatagttcattcaagtatataaagtgctttcgtgtattattattcagtggaataaaatgaatgttaacaggaaaaaaaaaaaaaaa

SEQ ID NO: 240 - DNA, 2311 bp, Homo sapiens
caaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcagg

SEQ ID NO: 241 - DNA, 6277 bp, Homo sapiens
tttcaaattctcttttattgctttatgtccctgactcatgcaggccaaagggtgaggaggagtaatagccaacaagagcgtcctgcagaaagaaacaggctgcgtgggtccggaggagcttgaaaggaagaacccgaccaaagggcaggagacccggctctccaggtcgcggaggcgtgggtgcccagccaggcggagtgcggggcggggcctctcgggccgcaaggtggggcctcctgggccgggaggtgggaggtgagctccgccagcccagcccactgcagacaggttacccaggacctcaaggtgtgctgcgtcaccccgcccgcgctgcgctgattggttcctccagggagcccccgccccctcagctgtaaccgggccggcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagttaattaaagaaaataagaagcatcaggagctcttcgtagacatttgttcagaaaaagacaatttaagagaagaactaaagaaaagaacagaaactgagaagcagcatatgaacacaattaaacagttagaatcaagaatagaagaacttaataaagaagttaaagcttccagagatcaactaatagctcaagacgttacagctaaaaatgcagttcagcagttacacaaagagatggcccaacggatggaacaggccaacaagaaatgtgaagaggcacgccaagaaaaagaagcaatggtaatgaaatatgtaagaggtgagaaggaatctttagatcttcgaaaggaaaaagagacacttgagaaaaaacttagagatgcaaataaggaacttgagaaaaacactaacaaaattaagcagctttctcaggagaaaggacggttgcaccagctgtatgaaactaaggaaggcgaaacgactagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactagaagatctgaagagaacatttaaggagggtatggatgagttaagaacactgagaacaaaggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaagaggtaagcaagaaattgaaaatttgaaagaagaagtggaaagtcttaattctttgattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtgaacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcaaaaagcacatgcccggaaaaatgaaaagatagaatttatggaggaccacatcaaacaactggtggaagaaattaggaaaaaaacaaaaataattcaaagttatattttacgagaagaatcaggcacactttcttcagaggcatctgattttaacaaagttcatttaagtagacggggtggcatcatggcatctttatatacatcccatccagctgacaatggattaacattggagctctctttggaaatcaaccgaaaattacaggctgttttggaggatacgttactaaaaaatattactttgaaggaaaatctacaaacacttggaacagaaatagaacgtcttattaaacaccagcatgaactagaacagaggacaaagaaaacctaaaacaagcctcttgctcagtaaagagacaaaagccacacaggagtaggtgccactgacctctattgttggagactttgttccactttttgtttcagccagtaaaaatattgttttgcttcatctgtacacaaaaaaatacccttttacaatatgaatgcattgctgtatatactgtaagactgaaagctttgatgaaatttgtttttgtatggtgcaatatgacagcctgtcattgaatctaaacaacttaatttgcttgtattcataagaagtgttgaacattacaagggcttttataaaaaaccctttgttcatatttcttccctttaaaatatgtaatgtcaaaaatgactcaccttttaaaaattatgcatgaaaacaggtggtaaacattcagtaatacgctatttctccaacatcaagacaactaaaacaaatgataaaaatgtttatttttacactccagcatatcgggtgagttttagggatgtgtatgaatatttaaatcttttaatttcagttttaatgaaagctgaacttaataggaaagctagctcttggtaactagcaatgatcaggcattgtttgcctctgtcaggttttcttatctgttttaggtacattttttcagattctgattgtttgagttaatggttgaatttttaaagtttttagttacttaaaatatgattttaaattacatattaatttagaaaattcctgtgtttacttatattttaaattgtgaaatggatccaatcattagaacagagagaatagttctttgaaactgaaatactttagttttactgaccttgtgtaaagataatatgaagaaccagcttccaaaagaaaccagcatatggcactataaactatttcatttgagcaccattctttaccatggatatattaattatgtattatagtggagtgatcatacagttcccccaaatgtgatgtttcagtgtatttatttaaaacataaagtagaccaggtgcagtagctcacgcctgtaatcccagcactttgggaagccaaggcaggaggattacctgaggccaggagtttaagaccagccttggcaacatagcgagacccccatctctacaaagaaattttaaaagattatccaggcatggtggtgcatgcctatggttccagctactcgggaggctgaagcggtagaatcacttgagcacaggaggtcaaggctgcaggtgagccatgatcgtgtcactgcactccagcctaggcaacagagcaagaccctgtctcttaaaacaaaaaacctcacacatacctaaaataagtatatatctgtaaccaaaggaacttaattttagagccaaatttttctatcttgttggattttttacagtgtttaagatagacacttaagtgttgccgtagtatcaatatttctgtcattgaattttttctcaccccttattatttctcacttacaatttctgagcatgatttttcataattcattatcttcagatcattactataataagataccgtggctcttatgcagatattgcagcaagccttgtttggtttggatttttgcatccctttttctcccattaagggaattaagttttgggatgatggattaaaagcctgtaaagaattgtttgggctctaaaagttgggctcatggtggcaatatccttttaatgtgttttaacattttttaatcaacatcgtttaaaaataatttactaaggattagattatttaatgaatgtctttttttctatatattgaattagatgttatcccaaaaaaaatatcttttcacttcaaaatgaaaatatatgttcaaagatgttttatttttagaatagttataaaaagtattagtcttaacataatgtgtcttgttctttttaccaataataatttatcaaaataagagggaaagtgcaatcaaatctgaattattttactatttgtttctagacacactacttaacactcctaaagactactttgagtaggcaacataactaaatttttctagtttcttatgatacaggttcataaactacaatatttggatttttttccccaaggcacaaaatgtataatggagaccaaatagtgatctgatccatagtatcctatgcctatacactttaaaatgtatatacattttagacaaaaatgcacactccagtattaatatttgtgctaccatctacttggagaagtttaatgagaaaattttagaagaaaagtattacaaacaatattttgactctattacctgttttgccttatacattttagaaactggaaattttttaaagaaaatgctttagttttcttctgttcttcactgtctacagtgtgcttttgtatatggatcaggactgagcaaagtaattacatgtatcagagatacttatctctatactaattcacagacagctcctgatgtaaggatttagagggccttctgccctctgaatatatggtgaggagaatggggtatctggaaaaggaaaatgatctggataaatctgagacctggggggaagtttgttttatatgttcattattggttgttacatatcaaggctgttttggttatgtatcaatattgtggtttatttgagctggaagtgattttttctgtgtatgtatatgtatacacttcaataggttttaattttgaagtgaatatttgccatgactccattttccccataccacttcagactttagcctgtttagttttaaggactgaaaatggtaggtttgggcagaagaatgaatttgaactttgatggggtttttttgtttttactttctatcttcataaccatttaaagcgatttagcttgaaattaaattttatcaggctaccaacatgttatttatttatttaataaacacatttattgaaaacc

SEQ ID NO: 242 - DNA, 1032 bp, Homo sapiens
gcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtg

SEQ ID NO: 243 - DNA, 6859 bp, Homo sapiens
ggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtcc

SEQ ID NO: 244 - DNA, 3897 bp, Homo sapiens
ggcagcctaggccgggcgagggccatgctgagcctcgcagccaagctggtggccttcttctggaggacggcggacacccctagggaggaagccgggcagctggagcccgagctcgcggaaggtgacactaagctgaaaactgtacggggtgtcgtgacaaggtactgcagcgattatggcatgattgatgatatgatctacttctccagtgatgctgtgactagcagagtgcttctgaatgttggacaggaagtgattgcagttgtggaagaaaataaagtgtccaatggactgaaagcaatcagggtagaagctgtctctgataagtgggaagacgacagcagaaaccatgggagtccctcagactgcggcccccgagtgttgattggctgtgtgacttccctggtggagggcgcaggctgtatcagtcagaccacctacttctctctggagagtgtgtgcgaaggcttcgagccctgcaagggagactgggtggaggctgagtaccggatccggcctggcacgtggagcagcgaagccacctcagtgaagccactgagatacaagcgcgtggacaaggtctgcatctctagcctctgtggaaggaacggggtgttagaggaaagcatcttctttaccttggactccttgaaactgccagatgggtacacaccccggagaggtgacgtggtcaatgcagtggtggtggagagcagccagtcatgctatgtctggagggcactttgtatgaccctagtgaagaggcgagacgccgcccctgttcatgaggccactcatttctatggaacgattttgctgaagaacaaaggtgatattgaagttacacaggtgacgcattttggaaccctaaaggaaggaagaagtaaaaccatggtgatctggatagagaataaaggagacattcctcaaaacttagtcagctgtaaactggctggctgggataaatctaaacaattcagattccaaatgctggataaagaccagatgtgccccgtggtatcttttgtttctgttcctgagaaggagaattcatcagatgaaaatattaattcattaaatagccacacaaaaaacaaaacctctcagatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctctgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcagctacgtgactgagattcatgaagaagatgtaactcttaaaattaatccagaatttgaacaagcctataactttgaacctatggatgtggaatttacatataataggaccacaagcagacggtgtcactttgcacttgaacacgtcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggagatagttattgacgccgtcaaaccgtattgcagagacggagaagacatctggaaagcctcacgcttccggataatcatcaccacatgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgtacggtcaaatgaagatagatttgaagatgatcgatattttttgggtttcttgtccaactcaaaaagatttaatgttgcaatcaccagacccaaagctttgctgatagtgctgggaaacccccatgttctcgttcgagacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgaccccc

SEQ ID NO: 245 - DNA, 5525 bp, Homo sapiens
aggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttc

SEQ ID NO: 246 - DNA, 396 bp, Homo sapiens
atggagatgggcaaatggattcatttagagctgcggaacaggacgccctccgatgtgaaagaacttttcctggacaacagtcagtcaaatgaaggcaaattggaaggcctcacagatgaatttgaagaactggaattattaaatacaatcaacataggcctcacctcaattgcaaacttgccaaagttaaacaaacttaagaagcttgaactaagcagtaacagagcctcagtgggcctagaagtattggcagaaaagtgtccaaacctcatacatctaaatttaagtggcaacaaaattaaagacctcagcacaatagagcccctgaaaaagttagaaaacctcgagagcttagaccttttcacttgcgaggtaaccaacctgaacaactactga

SEQ ID NO: 247 - DNA, 7333 bp, Homo sapiens
agaaatccagcccttctgccctccggaggcgcctttcccaacgtaaagtacaattttaaatttcagctcctgactaaaatcatgatccgcagtcaactgctagagaatctgggcaccccggtgtctctggagcgtgcagcgagtgtgggcaagggcagggggagtgggcgaagctgctggttggtgcctgaaatctgtgcgttgcccctttaattgtgtccccagccctcgggcgtttctgtccaacgcccacgtcagcaaataccttttgtttctctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctggtgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaagtgtttgaaatcattcatatttgaaatttttatcattagcttaaaaattactctcagtattgttaaaaaaaaaaaaaagtagaggctggccaaagattatatacagatattttcttaaagcaggaaactaatgttgcctaaaagtcaaggtagtttgtgaagacaatctgtcaatatggttgtccatctctctaaagaaaagcaggctgggcgctgtggctcatgcctataatcccaatactttgggaggccgaggcaggcggatcacaaggtcaggagtttgaaaccagcctggccaacatggtgaaacctcgtctctactaaaaaatacaaaattagccgggcatggtggcgggtgcctataatcccagctactcgggaggctgaggcaggagaatcgattgaacctggaaggcagaagttgcagtgagccgagatcacaccattgcactccagcctgggcaacaagagcgaaactccgtctcaaaaaaaaaaggaaaacaaactaggaggttcttaccatatgtgagtgatttctaacgtttatgtagtgctatattatttataaagtactctctcatgtattttctcagtgaggtggatactatctccgatttacaaatgaggaaattaaggtcagaaagtctgagagagaaaactgatgattggacaggatctgattttaaacaatcctctttcagccttctctccctgtatgtctcctgaaatggcaaagaatagaagtcaaacctcaccagttggcagtcattataaaaataagccaatcagaattagaaagtatgaaaggaggaattgaatcattttcaacaacatacaatatcttgatctagagattttcaaataatgctaagtaatgtccctacagtacctattggtatgtttttatgtcacgttatttatatgtaaatttaaagtataaaactatttgaacaaattattcacttaaatatgttgaacatttttgcttctcttgtttatataatattttcaaaacaaacttttctcctagtatacaaagtttaaacttctcccctttgggctgggcccagtggctcacgcctgtaatcccagcactttgggaggctgaggcaggtggatcaccgaggtcgggagtttgagaccagcctgaccaacatggagaaaccccgtctctactaaaaatacaaaattagccgggcgtggtggtgcatgcctgtaatcccagctactcagaaggctgaggcaggaggatagcttgaacccaggaggcagaggctgcggtgggctgaggttgcgccattgcactccagcctgggcaacaagagcgaaactccgtctcaaaaaaaaaaaaaaaaaaaacttctcccctgcataaattatgaaacattccaaaattacagctaaattagagaagcattgtttcagttctaaaggtaaaatctaaatatccgaagtaaagaactgagcttcataaaggtctcttctgcaagttatcacagtgaagcttgatagaatttcactgtatatggagaggctccatctattttactgttttcttttttgtttttgtttttttttcgagacggagtctcgctctgtcgcccaggctggagtgcagtggtgcaatctcagctcactgcaagctccacctcccgggttctcgccattctcctgcctcagcctcccgagtagctgggacttacaggcgcccaccaccactcccagctaattttttgtatttttaatagagatggggtttcaccgtgttagccaggatggtctcaatctcctgatctcgtgatccgcccccctcggcctcccaaagtgctgggattacaggcgtgagccactgcgcccagccaattttactgtatttttaaatgccatgacatacctcaaaattatcctttttatgttactattttctcttgttctttcattaattattgtccttgataccaatttctaggctaaattggttactttcttttaaaaaatttaaaaatagatgaataaccacttgtttcatggtacttaattgagactttttcaagattcccctgatggcacatttgcagttgcttcaagactggatgatgtgcattgagttctctgttctcccaacatggctgttcctaaatcaggattctggtttttttgagatggactctcgctctgttgtccaagctggagtgcagtggcgtgatctcgctcaccacaacctctgcctcccgggttcaagcgattctcctgcctcagcctcctgagtagccgggactacaggcatgtgccaccatgcctggctaatttttgtatttttagtagagacagggtttcgctatgttggccaggctggtctcgaactcctgacctcgtgatctgcccgcctcagcctcccaaagtgctgggattacaggcgtgagccagcacgcccggcctaaatcaggattcttaacaattaaagtgtatctgaatgaggaaggaaacgcttgtcattctctagtcttacccaattaatactgacaccttttgaaattaaaacctgattttttagttgttggagccagtaggaaaaatggctgatttgaacttttttcctataaatgaagtagtgcttgcatgtgtgtactctaatgcactttagtctatgatctaaatgtccttttatgctattatcttctgcatgcaaactttacatacatcagcatgaatatccaacattcactgaacacagtgccaccagcacttgtaattgccttttcagaaataatgctttctcataattgtttataacgagcatcaaactatccccacaaaatgatcaagttcaccaaactagacaaagaatctgttgtatcattttaacatcatagaagaacatttaagacatgtttgtaagttgtaaataatgactccagttatagcatatatatctaagacgttagagaccagttattttctagagtgaaactgtctattgatgattgagaaaattgaattctttggtttttacatgtgggcaaatgttacataggggtataatctgtttaaataagctttatttatgccaaggattttttttttaatatcaagacttggttagaccaaagtttgctcttgcaggaatgccatttatcagcttctgaatgcccttctaactccattaccctcaagagtgtctgggtataggatgaagcattacaaaaagaaagcaccactgcagtcatgcctagtgtctgggagaaacaaaatggactagacctgcagtttaaaataatttaacccgagaaactcttcaaatgaattgtttcctaaagatgctcaaatttaagggataaactctaaaatcagagctgctgtggttaaagtcccccacaaacctttccccagacacctctgcagaactcaggtgcacaatgttgaaaaccatggaattagacaacttcctgaattccctttgagccttgcagcctcatttcgttactcctgttactcacggtgcttataagcaggtaaccatatggtctcttagtgaagcaaatcacatccttagcacatgatgttccttctatgggtatcagatcttaagactttttaaaatttaggaacaaatgtttcaatattatattttcagtaatgcaatcaaaataagcatagttactgttttctgtacggctaagtactgcctaatggatgaaagaagtttggtgcttcaattatttatgagctcagaactcaattcattaaagttattttgccaagtcatgccaagatatattgaaatttccactcatattggtttttaaaattttttttagtcctaaaattaataagtatggaaaatcactaaaagcagtgtaggataaggtgtgtttaactggccgggcacggtggctcatgcctgtaatcctagcactttgggaggccgaggcgggcggatcacttaaggccaggtgttcgagaccatcctggccaacatggtgaaaccccgtctctagtaaaaatacaaaaaatagctgggcatgatggtgggtgcctgtaatcccaggtactcgggaggctgaggcaggagaatcgcttgaacccgggaggtggaggttgcagtggccgagatcgcaccactgcactccagcctgggtgacagagcgagactccatcaaaaaaaaaaaaaaaaaaaaaaaagatgtgtttaactgggaagggtgataataatagaataataggtacaggaggaccaaactttagattataaaccagaaagttttgttattttatataagtgtatcagtattactatttatcatttatatagcattttatatttgcaaagtgtttaataatttttgttattctttacatatatatgaaataggacagttatcccacatgaacggtaaataaattgaggcacagaacagtaaaaaaacctcagggtcaggcgtggtggctcacacctgtaatcccagcactttgggaggccaaggcgggtggatcactttaggtcaagagttggagaccagcctggggcaatatagtgaaaccccttctctactaaaaatacaaaaattagccaggcatggtggtgggcacctgtaatcccagctactctgggggctgagacaggagaattgcttgaactcaggaggcggaggttgcagtgagccaagatcacgctactgcactccaggctgggtgacagagcgagactccacctcaaaaaaaaaaaaaaaaaaaaaaaaaagaacctaagacaacccagtgaaatggtagcaaaaaataggaaatataatgatcacattttctgaatcctagaccatcagcctaattcactgaggtgtgttgtgtatcactctattttatagatgattttatataagtaacagtggattgttttaaagctgacgtcattgtatgtggatacattctatatggaataaatgttatgtaaagga

SEQ ID NO: 248 - DNA, 702 bp, Homo sapiens
aacttgggagctctgtacttttaagagctaaatctattttttcttccgtagttggcaacaccattatgacatcacaacctatttccaatgagaccatcataatgctcccatcaaatgtcatcaacttctcccaagcagagaaacccgaacccaccaaccaggggcaggatagcctgaagaaacgtctacaggcaaaagtcaaagttattggggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttatgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggttactcatgtcctcaaagacgactcatgatgctggatatgaagaactattgacttcttgggaaaaaacggagaaatattaattggaaagttgatttttatgataatatggaaaacctaaccattataaaaaagcaaacttgagtttcctaaatgtaagcatttaaagtaatgcatatttgtttt

SEQ ID NO: 249 - DNA, 1650 bp, Homo sapiens
cctctgactcttgctgactttgaagccataaatcgctgtaacaggccattgcctaaaaactttaactttgctgcagatgtgctggaccagtggtcccaaaaggagaagacaggggagagaccagctaacccagccctgtggtgggtgaatggcaaaggggatgaggtaaaatggagcttcagagaactgggctccttgtcccgaaaagctgccaacgtgctcaccaagccctgtggcctgcagagaggagaccgtttggccgtgattctgcccagaatccctgagtggtggctggtcaatgtagcttgcatacgaacagggatcatcttcatgccgggaacaatccagctgacagcaaaagacatcctctaccggctgcgagcatccaaggccaagtgcattgtggccagtgaggaggtggccccagcggtggagtccattgtattggagtgtcctgaccttaagacaaaactcctggtgtctccacaaagctggaatgggtggctcagcttccaggagttatttcaattcgcctctgaagagcacagctgtgtggaaacaggaagtcaagaaccaatgaccatttatttcaccagtgggaccacaggctttcctaaaatggcccagcactctcagagcagcctcggcattgggttcaccctctgcggaaggtattggctggacttgaagtcctcagatatcatatggaatatgtctgacacgggctgggtcaaggccgccattggcagtgtgttttcttcctggctgtgtggagcctgtgtttttgtgcatcgaatggcacagtttgacactgacaccttcctagacacacttactacttatcccatcacgaccctgtgcagtcctcccactgtgtaccggatgctcgtgcaaaaagaccttaagagatataaattcaagagtctgcggcactgcttgaccggaggggagccactcaacccagaagtgctggagcagtggagggtgcaaactgggctggagctatatgagggctatggacagacggaagtgggaatgatttgtgccaatcagaaaggccaagaaattaaaccaggttcaatggggaaaggaatgctgccctatgatgtccagattatagatgaaaatggcaatgttctaccacctggcaaagaaggggaaattgccctcagactcaaacctacacggcccttctgtttcttctctaactatcttgacaatccacagaaaactgctgccacgataagaggagatttttatgtcactggagacagaggagtgatggacagtgatgggtatttctggtttgtcggcagagctgatgatgtcattatatcctctgggtaccgtattgggccatttgaagtggagagtgcactcattgagcatccagcagttgttgaatcggctgttgtcagtagtccagatcaaatccgcggagaggtggtgaaagcttttgttgtcttagctgcaccctttaagtcctacaacccagagaaattaactcttgaacttcaggatcatgtgaaaaaatcaactgcaccttacaaatatccaagaaaggtggaatttgttcaagaactcccaaagacaatcactgggaaaatcaaacgcaacgttttaagagaccaagaatggagaggaagatag

SEQ ID NO: 250 - DNA, 2098 bp, Homo sapiens
atctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccacgcccaccccctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagc

SEQ ID NO: 251 - DNA, 2070 bp, Homo sapiens
ttgattatgtatcccttttgcttttcagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagactgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacaggtatcttcctattataataaagaagggagagaatgggtcataaaatcaacccaactggctatcaagagaattataccttgcagaatggcacctttggtattagaactgcctaattttgcattaaaatgtaagaatttgcttttcttactgactgttagtaatctttggaaaaagcactcaagtgtacactgtacatatagtgttttgcatgtgcaaaaattgtctcaacaactagtagtgaaaaaaaataaagtagaccgtgaaaatgacaacaaaccagatactgaacatgtttttaacccagacaaggaaaatttttgtaatgatacagaaagtatgaaagcaagaaacccagaagtagttatggttgaaataaaagaagaccagcaaatgacaaaaaaccaaaacaccacgaattggaaattaaacataggacatatgcctcaatttagtgattcaaaaaaccttttagatatgtggcttaactgctccaaagaaatgaagcatgtaattaaaaaaaaaaaagaacacaacagtacaaaaccaatacagaatgtgttccagaagctgttatatgacaactgtagtgcaaataagtatgaaagcataaaacatgaattagaaaatgtgcattattctccaccacttggtgacagaacatcagcagaaaatctcttgtgtaaaatggggttatctaaatacataattgtacgtgtaaatagattgtttttgcaagtgaaaaaccaaatacattctagggatgaccttgatgacataattcagtcatctcaaatagcctcagaggatgatgactcgctttgctctaattgtaagaaagtcatattactcattgatcaacatgaaatgaagtgcaaagaaatatgccttatgttaaaccaaagagctatgatcatttcactgtacttttctcagtgtgaatggcacgcccaatgtgtttgtttactctgcttctcttctatgccattacccatttcagctgccatttattgctataaggtatggatctcagtcctcgagctttatattgcatcattgcatacccttctctgtgccacagccagtgccttaggtgtttgctcctacaatcaggaaagattttgtcaactaaaaaaacaaaatatgttgcttcaacagcaactggatgatgctcgcaacaaagctgacaatcaagaaaaggcaatacttaatattcaagccagatgtgatgctagagtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaagtaagtatcaagaaaacattgcagattcatcaggatgatgtcttaaacaaacaatcagcaacaaaagctttgctggatgcttcatcgcgtcactgcatctatttagaaaatgagatgcaggattcaaggaagaaattagaccagatgagaagtcaagtatgtatgcaactttgcacgccaacaactgttaatctgtag

SEQ ID NO: 252 - DNA, 1183 bp, Homo sapiens
cttcagaggcccggcgacctccagggctgggaagtcaaccgagctcccttccaggtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagagcggagccacactcccttctgcacctgagccgcctgtgtgtgcgccacaacctgggggatacccggctcggccaggtgtctgccctgcccttgccccctgccatgaagcgctacctgctctaccagtgagccctgtgataccacagactgtgctgaggtcttgccaccacccctccccttggggaggtggggaggcactgctggcctagaccagctgctgaaagctggtgaggctgagcccctaccccaacccaagctctgcggaaatcaacagccccagagccacttggagggaggaagaaagggagccggcgttcaaggctatgacagtctgctacgcaaaacattttttcaagtaaaaatagtaagagatgttgttat

SEQ ID NO: 253 - DNA, 3698 bp, Homo sapiens
aggacgccactgccctgtcgccccgcctgtgcagcccaggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaattttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaac

SEQ ID NO: 254 - DNA, 4869 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 255 - DNA, 742 bp, Homo sapiens
agctaatttaaggctggacacagagtcagcaacacacaagacatcatcttgaaggaaggatggctttggccagaccaagaccgagacttggagacctgattgagatttctcgctttggctatgcacactgggccatctacgtgggagatggctatgtggtccatctggctccggcaagtgaaattgctggagctggtgcggccagtgtcctgtctgccctgaccaacaaagccatagtgaagaaggaactgctgtctgtggtggctgggggagacaactacagggtcaataacaagcacgatgacagatacacaccactgccttccaacaaaatcgtcaagcgggcagaggagttggtggggcaggagttgccttattcgctgaccagtgacaactgcgagcacttcgtgaaccatctgcgctatggcgtctcccgcagtgaccaggtcactggtgcagtcacgacagtaggtgtggcagcaggcctgctggctgccgcaagccttgtggggatcctgctggccagaagcaagcgggaaaggcaataaatccaagaaattgtcccaacaaccaccaattcttacggaggaatattatttagccagcaggagtggagtttggtttactgattttactgttttgtgttcatgaatctttattttaatggagttaaaagcacaggaaaatgtatttggaaatgcagcttagtatgaattctattaaagacacaattgggctctgc

SEQ ID NO: 256 - DNA, 794 bp, Homo sapiens
tcaggtcaggatgggcaccgtgcgcccacctcgcccctcgctcctgctggtctccacccgggagtcttgtctcttcctcctcttctgcctgcacctgggcgccgcctgcccacagccctgccggtgccctgaccacgcaggggctgtggctgtcttctgcagcttgcggggccttcaggaggtccccgaggacatcccggccaacaccgtgctcctgaagctcgatgccaacaagatctcccacctcccggacggggccttccagcacctgcaccggctcagggagctggatctgtctcacaacgccatcgaggccatcggctccgccaccttcgcgggcctggccgggggcctgcggctgctggacctgtcttacaaccgcatccagaggatccccaaggacgccctgggcaaactcagcgccaagatacgcctgtcccacaaccccctgcactgcgagtgcgccctgcaggaggccctgtgggagctgaagctggaccccgactctgtggacgagatcgcctgccacacctcagtgcaggaggagtttgtggggaagcctctggttcaggctctggatgcgggtgccagcctctgcagcgtcccccacaggaccacagacgtggccatgctggtcaccatgttcggctggttcgccatggtgatcgcctacgtcgtgtactatgtgcgccacaaccaggaggatgcccggaggcacctggagtacctgaagtctctgcccagcgcccccgcctccaaggaccccatcggcccggggccctagcgcctgttcc

SEQ ID NO: 257 - DNA, 5669 bp, Homo sapiens
aatcgtccgccgctcccgttaccggggcaaccgcggcgcctcctccgtgtcggccccgatcgtccctccgcgccattttcaaactgctctagcgccggagcccgtgcctggacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcagattgagctaagagaacgagagatagaacgactgtcagttgctttggatggtggtcggtcccctgatgtcctttctctggagtctagaaataaaaccaatgaaaagcttattgctcatttaaatattcaggttgactttcttcagcaagctaataaagacctggagaagcgtatacgagagcttatggaaaccaaggaaacagtgacatctgaagtcgttaatttaagtaacaaaaatgaaaaactctgccaagaattaactgaaatagatcagttagcacagcagttggaaagacataaagaagaagtgcttgagactgctgataaagagcttggggaagcaaagaaagagattaaaagaaagctctctgaaatgcaggatcttgaagaaacaatggcaaaacttcagctggaattgaacttatgccagaaagaaaaggagagactgagtgatgaactccttgtaaaatcagacctagaaactgttgttcatcagcttgaacaagaaaagcaaagacttagcaaaaaagttgaaagttttgcagttacagaacgacaacttactctggaggttgagaggatgagactagaacatggaataaaacgtcgagacaggtcaccttctcgtttagatacatttctgaaaggtatagaagaagaacgagattattataagaaagagctagagagactccaacatataatacagcgaagatcttgctctacaagttatagcgcacgtgaaaaaagttcaatatttagaacaccagaaaagggtgattacaattcagaaattcatcagatcacaagagaaagagatgaacttcagcgtatgctagaaagatttgaaaaatatatggaagatatacagtccaatgttaaattattgacagcagaaagagataaactaagtgtcttatataatgaagctcaggaagaattatctgccctaagaaaggaatccacccaaaccacagcaccccataatattgttagtcttatggaaaaggaaaaagaacttgcgttatctgacttaagaagaattatggcagaaaaggaagctttaagagaaaaattagagcatattgaagaagtgagtctttttggaaaatcagaattagagaaaactattgaacatttgacatgtgttaatcatcagcttgaaagcgaaaaatatgaattaaagtctaaagtgttaataatgaaagaaacaatagagtcgttagagaacaaattaaaagtccaagctcaaaaatttagccatgtggctggtgactcatctcatcagaaaacagaggtgaactcacttaggatagtgaatgagcagctacagcggtcagttgatgactatcagcaccgactttccataaaaagaggtgaacttgaatcagcccaagcacaaattaaaatactggaggaaaagatagatgaactaaaccttaagatgacttcacaggatgaggaggctcatgtaatgaaaaagaccattggtgttattgataaagaaaaagactttctccaggagactgtagatgagaagacagaaaagattgcaaatttgcaagaaaacctagctaataaagaaaaagctgttgctcaaatgaagataatgatctcagagtgtgaatcatctgtgaaccagctgaaagaaacattggttaatcgagatcgtgagataaacagcctccggcgccagcttgatgcagctcacaaagaactcgatgaagtaggaagatctagagaaatcgcttttaaggaaaacagaagactgcaagatgacctggctacaatggcaagagaaaatcaagaaatctcattggaattggaagcagcagtgcaagaaaaagaagaaatgaagagcagagttcataaatacataacagaggtgtcacgatgggagagcttaatggctgccaaggaaaaagaaaatcaagatttgttagatagatttcagatgcttcataaccgtgctgaagactgggaggtcaaagcccatcaagctgagggagaaagcagctcagttcgactggaacttctttctattgacactgagaggagacatcttcgagaaagagtggagctattagaaaaagaaattcaagagcacataaatgcccatcatgcttatgaatctcagatctcatcaatggcaaaagccatgtctcgattagaagaagagctgagacatcaagaagatgagaaagcaacagtattaaatgacttgtcatctcttagagaactttgcattaaacttgattcaggcaaagatattatgacccagcaattgaattcgaaaaaccttgagtttgagagggttgtggtggaattagaaaatgtaaagtcagagtcagacctactgaaaaaacaactttcaaatgagagacatacagttaaaaacctcgaatcattgttggctacaaacagagataaagaatttcattctcacttaacctcccacgagaaggatacagaaatccagctacttaaggagaagttaaccctttctgaaagcaaattaactagtcaaagccgggaaaacaccatgcttcgagctaaagtggcacagttacaaacagattatgatgctctgaaaaggcagatctcaactgaaagatacgaacgagaacgagcaatccaagagatgcgtcgacatggtcttgctacaccaccccttagttccactctgaggtctccttcacattctcctgaacatagaaatgtgtaattatcagaaagaataatggctttcaatgagttcctatgtggatttttaaaagaacagaacagtaatgaaatatttgaagtacttgttgctgaaaatcatgaacatggacacaaattctacctctgtcaacttttatttaaatcagtgaatatgttaaaaagtttggtttaaaagaactatatctatatgtatattttcatatatatgacagaacaagaatatgtattaatagtgcctaatgtatctatatttttattattcatgaattaaattactaaaagtatgtttatactgtgaattaatataatgtattcacattattctttaataatctgtttattaataagccatgatatgtgtatgtaaatattcttacagtacttgtttttagttgtcatgcctatgtttagaccatatcttaatgtattcacaaagaattatcaactttgatgctatgctgtcatgcttaactttttcttcttaaaattattcatagatctactgtctgttgtcaaggggaatatattcaggtctagtcttcttataatagcagaggtcttggtaaaataactaccatatataacgtgttattgccatctagaagaactatgatgagaaagatacatttatatattatgtaaaatgttaactatcatcatatggactctatgtaacacaaattcaaaagcaaactaaaagctatatgcagagttttgtataaaacaatagaacagaaatttgggacatttttctaggaaataaaattcctcggtgtattaatctaaggtttcaaagtataaaagtatatggggtaggccgggtgcagtggctcacgcctgtaatcccagcactttgggaggccgaggcgagtggatttcctaaggtcaggagtttgagaccagcctgagcaatgtggtgaaaccccatctctactaaaaatacaaaaattatctgggcttggtggcgggcacctgtaatcccagccacttgggaggctgaggcaggagaattgcttgaacccgggaggtggaggctgcggtgagccaagatcatgccattgcactccagcctgggtgacagagtaacactctgtctcagaaaaaaaaaaaaagaaaaatatatggggtaaatacagtaaaacgttttgttaaattccaatatacattcagtgataccactctttttcttctaagcctgtgtgttataatttaccagttccccaaaatgccatttttaacgccgaactgtgtaatatacatggaaaacagctttttacaattaattttcaaagttgtaattttaaagaatttgggtgtatacctatgttaatgaaacaacagaagtacaaaaaagaatatcagatacaaaaatcaatcgtgaagaaaatctgttcttaatatatttcattatgattgaaaaacataaaaactaacataggaaagtgaatgatcagttacttatgatatattttgtttcctcttgtggtttaataaagtgaagtgtgtgtgtgtgtgtgtgtgtgtatacctgggggtgggcagtgctctttttctaaaactaatatggcttatatatctgaattatgccctttttagtgtgtattaggatgtgggctggtttgcttttctaccacctttgtaattttatgtatcccatctcctttgtgtgaattcatatattatagcaaaatacaagagacatgggactgtttgcaataccatatggaaatcttttaataaatatatgtaaataaaataaaaaatatttgtctccaccttttccccaaaagcaacagcaagacatattttgttagatattttatttttaatgttttctataatttaaaaatgtatagcctgccaaatgttgttttcataaccatgatattgttttgaaaaaattttatcttaaaatactgaatgttctgaccttttatagatgtttttgattttgttttaaataattttaaattatggagcttgacctagatttgccaataaactttctagcct

SEQ ID NO: 258 - DNA, 2619 bp, Homo sapiens
gagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggc

SEQ ID NO: 259 - DNA, 9215 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaatattttttaattcaaggtaaaatatattagtttcacaagatttctggctaatagggaaattattatcttcagtcttcatgagttgggggaaatgataatgctgacactcttagtgctcctaaagtttccttttctccatttatacatttggaatgttgtgatttatattcattttgattcccttttctctaaaatttcatctttttgattaaaaaatatgatacaggcatacctcagagatattgtgggtttggctccataccacaataaaatgaatattacaataaagcaagttgtaaggactttttggtttctcactgtatgtaaaagttatttatatactatactgtaacatactaagtgtgcaatagcattgtgtctaaaaaatatatactttaaaaataatttattgttaaaaaaatgccaacaattatctgggcctttagtgagtgctaatctttttgctggtggagggtcgtgcttcagtattgatcgctgtggactgatcatggtggtagttgctgaaggttgctgggatggctgtgtgtgtggcaatttcttaaaataagacaacagtgaagtgctgtatcaattgatttttccattcacaaaagatttctctgtagcatgcaatgctgtttgatagcatttaacccacagcagaatttctttgaaaattggactcagtcctctcaaactgtgctgctgctttatcaactaagtttttgtaattttctgaatcctttgttgtcatttcagcagtttacagcatcttcattggaagtatattccatctcaaacattctttgttcatccataagaagcaacttcttatcaagttttttcatgacattgcagtaactcagccccatcttcaggctctacttctaattctggttctcttgctacatctccctcatctgcagtgacctctccacggaagtcttgaactcctcaaagtaatccatgagggttggaatcaacttctaaactcctgttaatgttgatatattgaccccctcccatgaattatgaatgttcttaataacttctaaatggtgatacctttccagaaggctttcaatgtactttgcccggatccatcagaagactatcttggcagctgtagactaacaatatatttcttaaatgataagacttgaaagtcaaaagtactccttaatccataggctgcagaatcaatgttgtattaacaggcacgaaaacagcattaatcttgtgcatctccatcggagctcttgggtgactaggtgccttgagcagtaatattttgaaaggaggttttggttttgttttttgttttttttttttgttttttagcagtaagtctcaacactgggcttaaaatattcagtaaactatgttgtaaaaagatgtgttatcatccagactttgttgttccattactctacacaagcagggtacacttagcataattcttaagggccttggaattttcagaatggtaaatgagtatgggcttcaacttaaaatcatcaactgcattagcctgtaacaagagagtcagcctgtcctttgaagcaaggcattgacttctatctatgaaagtcttagatggcaccttgtttcaatagtaggctgtttagtacagccaccttcatcagtgatcttagctagatcttctgcataacttgctgcagcttctacatcagcacttgctgcctcaccttgtccttttatgttatagagacagctgcgcttcttaaactttataaaccaacttctgctagcttccaacttctcttctgcagcttcctcattctcttcatagaactgaagggagtcaaggccttgctctggattaagctttggcttaaggaatgttgtggctgacgtgatcttctatccagaccactaaagcgctctccatatcagcaataaggccgttttgctttcttacctttcatgtgttcactggagtaatttccttcaagaatttttcctttacattcacaacttggctaactggcatgcaaggcctagctttcagcctgtcttggcttttgacatgccttcctcacttagctcgtcatatctagcttttgatttaaagtggcaggcatacaactcttcctttcacttgaacacttagaggccactgtagggttattaattggcctaatttcaatattgttgtgttttagggaatagagaggcccagggagagggagagagcccaaacggctggttgatagagcaggcagaatgcacacaacatttatcagattatgtttgcaccatttaccagattatgggtacggtttgtggcaccccccaaaaattagaatagtaacatcaaagatcactgatcacagatcgccataacataaataataataaactttaaaatactgtgagaattaccaaaatgtgatacagagacatgaagtgagcacatgctgttgaaaaaaatgacactgatagacatacttaacacgtgggattgccacaaaccttcagtttgtaaaagtcacagtaactgtgactcacaaaagaacaaagcacaataaaacgaggtatgcctgtatttttaaaaaaagctttttgttaaaattcaggatatgtaataggtctgtaggaatagtgaaatatttttgctgatggatgtagatatatacgtggatagagatgaagatcttaattatagctatgcagcatagatttagtcaaagacatttgaaaagacaaatgttaaattagtgtggctaatgacctacccgtgccatgttttccctcttgcaatgagataccccacactgtgtagaaggatggagggaggactcctactgtccctctttgcgtgtggttattaagttgcctcactgggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatattt

SEQ ID NO: 260 - DNA, 1705 bp, Homo sapiens
gggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcgggaccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggcaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgctttt

SEQ ID NO: 261 - DNA, 1747 bp, Homo sapiens
actgccaccatgctggcctcagggctgcttctggtgaccttgctggcctgcctgactgtgatggtcttgatgtcagtctggcggcagaggaagagcagggggaagctgcctccgggacccaccccattgcccttcattggaaactacctgcagctgaacacagagcagatgtacaactccctcatgaagatcagtgagcgctatggccctgtgttcaccattcacttggggccccggcgggtcgtggtgctgtgcggacatgatgccgtcaaggaggctctggtggaccaggctgaggagttcagcgggcgaggcgagcaggccaccttcgactggctcttcaaaggctatggcgtggcgttcagcaacggggagcgcgccaagcagctccggcgcttctccatcgccaccctaaggggttttggcgtgggcaagcgcggcatcgaggaacgcatccaggaggaggcgggcttcctcatcgacgccctccggggcacgcacggcgccaatatcgatcccaccttcttcctgagccgcacagtctccaatgtcatcagctccattgtctttggggaccgctttgactatgaggacaaagagttcctgtcactgttgcgcatgatgctgggaagcttccagttcacggcaacctccacggggcagctctatgagatgttctcttcggtgatgaaacacctgccaggaccacagcaacaggcctttaaggagctgcaagggctggaggacttcatcgccaagaaggtggagcacaaccagcgcacgctggatcccaattccccacgggacttcatcgactcctttctcatccgcatgcaggaggaggagaagaaccccaacacagagttctacttgaagaacctggtgatgaccaccctgaacctcttctttgcgggcactgagaccgtgagcaccaccctgcgctacggtttcctgctgctcatgaagcacccagaggtggaggccaaggtccatgaggagattgacagagtgatcggcaagaaccggcagcccaagtttgaggaccgggccaagatgccctacacagaggcagtgatccacgagatccaaagatttggagacatgctccccatgggtttggcccacagggtcaacaaggacaccaagtttcgggatttcttcctccctaagggcactgaagtgttccctatgctgggctccgtgctgagagaccccaggttcttctccaacccccgggacttcaatccccagcacttcctggataagaaggggcagtttaagaagagtgatgcttttgtgcccttttccatcggaaagcggtactgttttggagaaggcctggccagaatggagctctttctcttcttcaccaccatcatgcagaactttcgcttcaagtcccctcagtcgcctaaggatatcgacgtgtcccccaaacacgtgggctttgccacgatcccacgaaactacaccatgagcttcctgccccgctgagcgagggctgtgctggtgcagggctggtgggcggggccagggaaacggccggggcaggggcggggcttgtgggaggggcggggctaagaatgggggcagtgggggaaggaaggggagaggtggttagagggaacagaagaaacagaaggggctcagttcaccttgatgatgtccttcagagctgtgatgagaggaagggaaaccttacagtatgctacaaagagtagtaataatagcagctcttatttcctga

SEQ ID NO: 262 - DNA, 4193 bp, Homo sapiens
ccgccccccaccggggcggggcgcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtg

SEQ ID NO: 263 - DNA, 4558 bp, Homo sapiens
cggccgcggcccggactccgcggtgggcgagcgccctgtgaggtgaccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagagcaaggtgaaatcatcttgaaggtgcctgtggagattgtagggcaggggaagttgggtgaagtggccctgctggccagcattgatcagcactgctcaaccacacgcctgtgcaacctcgtcttcacgccagcctggttctcacccatcatgtataagacaacatcaggtcacgtccagtttgacaactgcaactttgagaacgggcacatccaggtccatggcccgggtacttgccaagtgaagttctgtaccttcaaaaacacccatatcttcctgcacaacgtgcccctgtgtgtcctggaaaactgtgaatttgtgggcagtgaaaacaactctgtgactgttgagggtcacccatctgcagataagaactgggcctacaagtatctactagggcttatcaagtcctcacccacttttctccccacagaggactctgactttttaatgtccctggacctagagagccgggaccaggcctggagcccaaagacctgtgacattgttatcgagggcagccagagccctaccagcccagcctctagctccccaaagccaggctccaaggctggctcacaggaggcagaggtgggtagtgatggtgaaagggtggcccagaccccggacagcagcgatggaggcctgagtcccagcggtgaggatgaagatgaggaccagctgatgtacagactatcctaccaagtgcagggcccacgccctgtattggggggctcatttctgggcccacctctaccaggagcatccattcagctgcccagctgcctagtgctgaactcactgcagcaggagctgcagaaggataaggaggccatggcactggccaactccgtgcagggctgcctcatccgcaagtgcctcttccgggacgggaagggaggcgtcttcgtctgctcccacggcagagccaagatggaaggaaacatcttccggaacctgacttacgcagtgcggtgtatacataatagcaagatcatcatgctcaggaacgacatttaccgctgccgagcgtcaggcatctttcttcgcttggagggcggtggcttgattgccggcaacaacatttaccacaatgcagaggctggtgtagacatccggaaaaagtccaacccactctgtaaccagatccaccatggccttcgctctggcattgtcgtccttggcaatgggaaaggcatcatccggaacaatcaaatcttttccaataaggaggctggcatttacatcctgtaccacggaaaccccgttgtgagcgggaaccacatcttcaagggccgtgctgccggcatagcagtgaatgagaacggcaaaggcctcatcacagaaaatgtcatccgtgagaatcagtggggaggtgtggacatccgccgtggagggatccccgttctcaggagtaacctcatctgctttggctattcagatggtgtggttgtgggagacgaaggcaaaggcctcatagaaggaaataccatctacgctaacaagggctgtggtgtgtggatgatgtcgtccagcctcccccatgtcaccagcaaccacgtcagctacaatggcctgtatggagtggcagtatttagccagaaggatggctccagcgagttacctcgaggccacagggctcaagagaacttcagcgaggatggggacgccatcctctgggagacagagctggagaaggaggacgacccactgcgccggcccatcaccatagctcttgttgagtctaacagtattaatcacaatggagcctcaggactctatgtccagagcagcgaggcactgcatgtcatcaccaatgtgatccacgcgaatggggacagaggcattactgtggcccagagcagccaacccacccgagtggccaacaacagcatctcctgcaaccggcaaagtggggtcaaggttgaggcccagtgcaaagtggagctccggggcaatggtatctatgacaacagaggccacggcattatcaccaagggcgacagcaccatcgtcattgaaaacgatatcattggcaaccggggcagcgggctgcagctgctgcccaggtccgacactaaagtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcaggattttctctgagttctaaggaactgtgttttacacacaccaaacccagactcttctcaggaaagagcagatttacttctgatggcgggaagtgattctagtgaggtggagagagacaactgctccagaattttcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatgcacaaggctctactccatccccagagagctcccaaatgcagaaggattcaaaccccatgtgagcgtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggaaggccagctcccagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcacttggctgcgtggctggttctattggccctaggtgctgctctgttgggtgggatgggagggggtagagggagccaggagcactgggttctccctgagaacactgggcacaagagtactggcctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatatttt

SEQ ID NO: 264 - DNA, 1300 bp, Homo sapiens
acgggtcgagtgctggcttccggcggaaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgct

SEQ ID NO: 265 - DNA, 5814 bp, Homo sapiens
ggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactctgg

SEQ ID NO: 266 - DNA, 690 bp, Homo sapiens
gacgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggataggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcctggaccacctggacctaccctccagccatgacccttccctgctcccacccacctgactccaaataaagtccttctccccc

SEQ ID NO: 267 - DNA, 9146 bp, Homo sapiens
ccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggattgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcagagggttggc

SEQ ID NO: 268 - DNA, 1100 bp, Homo sapiens
gtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccc

SEQ ID NO: 269 - DNA, 2041 bp, Homo sapiens
cctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatgaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcgcgcgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagtcctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggagg

SEQ ID NO: 270 - DNA, 800 bp, Homo sapiens
gtaaggtgaaggtgcccagcaggctgaggcttgtgtgcaacccagaagagagctcgctaacgccagcaagaaggttcagaacagcctggctttggaaaggaatttcatcctgcccacacactgcatagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttg

SEQ ID NO: 271 - DNA, 2840 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctc

SEQ ID NO: 272 - DNA, 2834 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgcc

SEQ ID NO: 273 - DNA, 1276 bp, Homo sapiens
gcggccgccgtggccaggcaacctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatatttta

SEQ ID NO: 274 - DNA, 3137 bp, Homo sapiens
ctccgagccccccctccccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcagtacatttttatacctgaaattcctggtggtgtgggcacttgtcctcctagcagattttgtcctggagttcagatttgaatacctgtggccattctggcttttcatcagaagcgtctatgattccttcagataccagggactggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtct

SEQ ID NO: 275 - DNA, 4798 bp, Homo sapiens
cggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaataatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaaaaaaaaagaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgtggtgccacgttagccactaaatctgaacttttaccctgctttcatcatggatttttttgtgtaacctgaaacaagtcaccagtgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctcttcgtgaatacccatagcaatatgtaagattttattgaagtttcctgtgataactgaggaatactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaaccgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaaggg

SEQ ID NO: 276 - DNA, 3172 bp, Homo sapiens
agtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattc

SEQ ID NO: 277 - DNA, 1821 bp, Homo sapiens
agacttctgcgtcgcggaagcgggtcccgcaggtcgccacggttgggggaaacgcggcggacgccgcccccgtcccgaaggggactcgaaaatgtacagccagcggtttggcaccgtacagcgggaggttaagggccccacccccaaagtggtgatcgtgagatccaagcctcctaaaggccaaggagctgagcaccatctagaaagaatccgacgcagccatcagaagcataatgctattttggcttccattaagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagctacgtgagcttttagcattagaagaaaatgagtattttacagaaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtggaaagtaacaacgcacagattaaacatgagaatgaacaggatatgctaaagaaacagaaggcaaagcaggaaactaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagacgccaacgtttagcccaggagtacaggaagcaacttcagatgcaaatcgcctaccagcagcagtcccaagaagcagagaaggaagagaaacgccgagagtttgaagcaggtgtagcagcaaacaagatgtgtttggacaaggtccaggaggtcctgtccacccatcaagtgctgcctcaaaacattcatcccatgcgcaaggcatgccccagtaagcttccaccgtagttccgtgagcatcaatatatcttttcttggtcttttaatatttttaactacagtatgcttgtatgcttcttttaactcctggataaacttttcttttttccctgagtttgtgtaattaattgaacataattttcttcctttgaataaacctgtgcctattttggagttcacagacttacaaatcc

SEQ ID NO: 278 - DNA, 5437 bp, Homo sapiens
agtgggggcctgatagcgcggcggtgtggaccgcgcggccgaagagcgcggcgcccagagcgcgggccgctcgcggagccacagcccgagccgggtcccagccggagccgagccccagccgagccgagccgggcccggagcgcccggtgcccgcagccatgccggccggccgcgccgcgcgcacctgtgcgctgctcgccctctgcctcctgggcgccggggcccaggatttcgggccgacgcgcttcatctgcacctcggtgcccgtggacgccgacatgtgcgccgcgtccgtggccgccggcggcgccgaggagctccggagcagcgtgctgcagctccgcgagacggtgctgcagcagaaggagaccatcctgagccagaaggagaccatccgcgagctgaccgccaagctgggccgctgcgagagccagagcacgctggaccccggagccggcgaggcccgggcgggcggcggccgcaagcagcccggctcgggcaagaacaccatgggcgacctgtcccggacaccggccgccgagacgctcagccaactcgggcaaactttgcaatcgctcaaaacccgcctggagaacctcgagcagtacagccgcctcaattcctccagccagaccaacagcctcaaggatctgctgcagagcaagatcgatgagctggagaggcaggtgctgtcccgggtgaacaccctggaggagggcaaggggggccccaggaacgacaccgaggagagggtcaagatcgagaccgccctgacctccctgcaccagcggatcagcgagctcgagaaaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagttgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggaggggccaccaagtggaccttcgaggcctgtcgccagatcaactgagcacggcaggccaggctgagcccgcccgccctcgccccctgcttgtgcggcgatgatctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaagggtgaaggcaggccgtcctgggatggtaccctgtgctctcccgtggaggagaggggatggctgaggacactggcccttaccccagggccagacagcatccatccctgctgtttgcatctgagagcagcatggggcctgggaggtcggcctgtgtgcccagctcagctagctctgccccaggacggccctgccctcgaccttcccacctcctcagatcctgcaaggctggggtctgcccctcccttctcacctctggagctgtgctgcactgcttcagcccagagggccctgagagaggagcgtgccacccacagcccgggaagccgggccccagcacccctctcctttggcctccggcagtgcagaccagaggggaccttttaaggaaagaagccgtgtttcgatgaagacctggccacatggggccactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcacgccctgagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgcccggtgcgggctgtgtggggtgctcccctgccagcacctccggccagccccgcccctgccgatctactggaccgcagaccaccttctgcccccgtgggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaagcccaatacttagagtcccaattttgtctcatttgccaaaaaaaaaaaaaaaaaaaaagcaaaccccctatggttgatattgttataatgtatatactgtataatatgaaagagaatcgatgtatctcactttttcattatttgctaaccaaagctgtacatttttcatatgatctgcagccttttgggtatcaaatgggtcaaaaccatgggacctgccacctcccatcagcaattctggaaatgcactatttctactggtattcttgctttttttttttttttcattttcttgctgaaatgacatgaattgttgagtttatttttacacagtaaagagtggagaaagact

SEQ ID NO: 279 - DNA, 4848 bp, Homo sapiens
gactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggagcagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagagcagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagaccaacgagacttaggtaaggaatggaacctttcctgtggtttgactgcacattacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaa

SEQ ID NO: 280 - DNA, 8119 bp, Homo sapiens
cgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattactt

SEQ ID NO: 281 - DNA, 3365 bp, Homo sapiens
gagcgccaggaaggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcgggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtg

SEQ ID NO: 282 - DNA, 603 bp, Homo sapiens
gaggatgtccttaagttccttgcagcaggaatccacttaggtggcaccaaccttgacttccaaatgaaacaatacatttataaaaagaaatgtgacggcgtctatatcataaatctgaagaggacctgggagaagcttctgttggcagcttgtgccattgttgccattgaaaaccctgctgatgtccgcgtcatatcctccaggaatactggccagagggccatactgaagtttgctgctgccactggagccactccaattgctggccgcttcactcctggaatcttcactaaccagatccaggcaaccttccaggagccacagcatcttttctttactgattccagggctgacctgcctctcacagaggcatcttatgttaacttacataccattgctccacgtaatacagattctccgctgtgctatgtggacattgccatcccatgcaagaagggagctcactcagtgggtttgatgtggtggatgctggcctggaaacttctgcacatgtgtggcaccatttcctgtgaacacctgtgggaggggatgcctgatctcttcttctacagagatcctgaagagactgaaaaagaagagtaa

SEQ ID NO: 283 - protein, 323 aa, Homo sapiens
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 284 - protein, 1792 aa, Homo sapiens
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 285 - protein, 500 aa, Homo sapiens
MRNWLVLLCPCVLGAALHLWLRLRSPPPACASGAGPADQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQEGDALLHNLHSRPQRLIDHIRNLHEEDALLKEESSIYDDIVFVDVVDTYRNVPAKLLNFYRWTVETTSFNLLLKTDDDCYIDLEAVFNRIVQKNLDGPNFWWGNFRLNWAVDRTGKWQELEYPSPAYPAFACGSGYVISKDIVKWLASNSGRLKTYQGEDVSMGIWMAAIGPKRYQDSLWLCEKTCETGMLSSPQYSPWELTELWKLKERCGDPCRCQAR

SEQ ID NO: 286 - protein, 364 aa, Homo sapiens
MPRGRCRQQGPRIPIWAAANYANAHPWQQMDKASPGVAYTPLVDPWIERPCCGDTVCVRTTMEQKSTASGTCGGKPAERGPLAGHMPSSRPHRVDFCWVPGSDPGTFDGSPWLLDRFLAQLGDYMSFHFEHYQDNISRVCEILRRLTGRAQAWAAPYLDGDLPLPDDYELFCQDLKEVVQDPNSFAEYHAVVTCPLPLASSQLPVAPQLPVVRQYLARFLEGLALDMGTAPRSLPAAMATPAVSGSNSVSRSALFEQQLTKESTPGPKEPPVLPSSTCSSKPGPVEPASSQPEEAAPTPVPRLSESANPPAQRPDPAHPGGPKPQKTEEEVLETEGDQEVSLGTPQEVVEAPETPGEPPLSPGF

SEQ ID NO: 287 - protein, 120 aa, Homo sapiens
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 288 - protein, 1270 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 289 - protein, 393 aa, Homo sapiens
MKRTRDEVDATLQIAKLNAAELLPAVHCLGFGPGASGAAAGDFCLLELEPTLCQQLEDGHSLVIRGDKDEQAVLCSKDKTYDLKIADTSNMLLFIPGCKTPDQLKKEDSHCNIIHTEIFGFSNNYWELRRRRPKLKKLKKLLMENPYEGPDSQKEKDSNSSKYTTEDLLDQIQASEEEIMTQLQVLNACKIGGYWRILEFDYEMKLLNHVTQLVDSESWSFGKVPLNTCLQELGPLEPEEMIEHCLKCYGKKYVDEGEVYFELDADKICRAAARMLLQNAVKFNLAEFQEVWQQSVPEGMVTSLDQLKGLALVDRHSRPEIIFLLKVDDLPEDNQERFNSLFSLREKWTEEDIAPYIQDLCGEKQTIGALLTKYSHSSMQNGVKVYNSRRPIS

SEQ ID NO: 290 - protein, 310 aa, Homo sapiens
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHVVRTRLREEGTKYRSFFQTLSLLVQEEGYGSLYRGLTTHLVRQIPNTAIMMATYELVVYLLNG

SEQ ID NO: 291 - protein, 582 aa, Homo sapiens
AGQRLRPVPAPRSSAEEAARPGQLRLGIRRGEAELAKLAPSGVMVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMAG

SEQ ID NO: 292 - protein, 429 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 293 - protein, 571 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTGTSAVEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 294 - protein, 724 aa, Homo sapiens
MASWGGEKRGGAEGSPKLAVYATRKTRSVRSQEDQWYLGYPGDQWSSGFSYSWWKNSVGSESKHGEGALDQPQHDVRLEDLGELHRAARSGDVPGVEHVLAPGDTGVDKRDRKKSIQQLVPEYKEKQTPESLPQNNNPDWHPTNLTLSDETCQRSKNLKVGDKSPSVSPSMPENQSATKELGQMNLTEREKMDTGVVLLSGNDTLHDLCQSQLPENKESKEAEQDLELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKLHLHENKLDCDNDNKLGIGHIFSTDNNFHNDASTKKARNPEVVTVEMKEDQEFDLQMTKNMNQNSDSGSTNNYKSLKPKLENLSSLPPDSDRTSEVYLHEELQQDMQKFKNEVNTLEEEFLALKKENVQLHKEVEEEMEKHRSNSTELSGTLTDGTTVGNDDDGLNQQIPRKENEEHDRPADKTANEKNKVKNQIYPEADFADSMEPSEIASEDCELSHSVYENFMLLEQLRMEYKDSASLPRIQDTFCLCEHLLKLKNNHCDQLTVKLKQMENMVSVLQNELSETKKTKLQLELQKIEWEKELYDLRLALKQENGRKEMPICCIIKIVNS

SEQ ID NO: 295 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 296 - protein, 241 aa, Homo sapiens
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQIEHLVITLGSLRLDCPAAVVDDNEKNLSLGLQTLRSLKCIINLDKHRLIMGKTDKEEIPFVETVSLNEDNTSEA

SEQ ID NO: 297 - protein, 118 aa, Homo sapiens
MCDKEFMWALKNGDLDEVKDYVAKGEDVNRTLEGGRKPLHYAADCGQLEILEFLLLKGADINAPDKHHITPLLSAVYEGHVSCVKLLLSKGADKTVKGPDGLTAFEATDNQAIKALLQ

SEQ ID NO: 298 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 299 - protein, 599 aa, Homo sapiens
MSGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 300 - protein, 816 aa, Homo sapiens
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNVSFLILTSIFPSQFSNIKCHIHPLFLYLKIMS

SEQ ID NO: 301 - protein, 393 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 302 - protein, 227 aa, Homo sapiens
MTDFKLGIVRLGRVAGKTKYTLIDEQDIPLVESYSFEARMEVDADGNGAKIFAYAFDKNRGRGSGRLLHELLWERHRGGVAPGFQVVHLNAVTVDNRLDNLQLVPWGWRPKAEETSSKQREQSLYWLAIQQLPTDPIEEQFPVLNVTRYYNANGDVVEEEENSCTYYECHYPPCTVIEKQLREFNICGRCQVARYCGSQCQQKDWPAHKKHCRERKRPFQHELEPER

SEQ ID NO: 303 - protein, 491 aa, Homo sapiens
MPGARDALCHQALQLLAELCARGALEHDSCQDFIYHLRDRARPRLRDPDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARHNSIRRQLNLSNPDFNIQQLQKQEQLTGIGRIKPELYKQRSLDNDDGRRSNSKACGKLNFILKYDCDLEQLIVKIHKAVNLPAKDFSGTSDPYVKIYLLPDRKTKHQTKVHRKTLNPVFDEVFLFPVPYNDLEARKLHFSVYDFDRFSRHDLIGQVVVDHFLDLADFPRECILWKDIEYVTNDNVDLGELMFSLCYLPTAGRLTITIIKARNLKAMDITGASDPYVKVSLMCDGRRLKKRKTSTKRNTLNPVYNEAIVFDVPPENIDQIHLSIAVMDYDRVGHNEIIGVCQVGNEAERLGRDHWSEMLSYPRKPIAHWHSLVEKR

SEQ ID NO: 304 - protein, 410 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 305 - protein, 914 aa, Homo sapiens
MENWPTPSELVNTGFQSVLSQGNKKPQNRKEKEEKVEKRSNSDSKENRETKLNGPGENVSEDEAQSSNQRKRANKHKWVPLHLDVVRSESQERPGSRNSSRCQPEANKPTHNNRRNDTRSWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEALKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSRAKITSELAKVINDGLYYYEQDLWMEEDENKHTAIKQEVENFKKLNLISKEQFENLTPELPFEPNQEVPVAPSQSRQGGVQGVLHIPKKDLTDELAQKLFDVSEITSAAMVHSLPTAVPESPRIHPTRTPKTPRTPRLQDPNKTPRFYPVVKEPKAIDVKSPRKRKTRHSTNPPLECHVGWVMDSRDRGPGTSSVSTSNASPSEGAPLAGSYGCTPHSFPKFQHPSHELLKENGFTQQVYHKYRRRCLSERKRLGIGQSQEMNTLFRFWSFFLRDHFNKKMYEEFRQLAWEDAKENYRYGLECLFRFYSYGLEKKFRREIFQDFQEETKKDYESGQLYGLEKFWAYLKYSQSKTQSIDPKLQEYLCSFKRLEDFRVDPPISDEFGRKRHSSTSGEESNRHRLPPNSSTKPPNAAKPTSTSELQVPINSPRRNISPESSDNSH

SEQ ID NO: 306 - protein, 480 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 307 - protein, 401 aa, Homo sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 308 - protein, 305 aa, Homo sapiens
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 309 - protein, 295 aa, Homo sapiens [sequence omitted]

SEQ ID NO: 310 - protein, 566 aa, Homo sapiens
MDLHRAAFKMENSSYLPNPLASPALMVLASTAEASRDASIPCQQPRPFGVPVSVDKDVHIPFTNGSYTFASMYHRQGGVPGTFANRDFPPSLLHLHPQFAPPNLDCTPISMLNHSGVGAFRPFASTEDRESYQSAFTPAKRLKNCHDTESPHLRFSDADGKEYDFGTQLPSSSPGSLKVDDTGKKIFAVSGLISDREASSSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 311 - protein, 451 aa, Homo sapiens
MAEGAQPHQPPQLGPGAAARGMKRESELELPVPGAGGDGADPGLSKRPRTEEAAADGGGGMQNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 312 - protein, 259 aa, Homo sapiens
MDRSAEFRKWKAQCLSKADLSRKGSVDEDVVELVQFLNMRDQFFTTSSCAGRILLLDRGINGFEVQKQNCCWLLVTHKLCVKDDVIVALKKANGDATLKFEPFVLHVQCRQLQDAQILHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 313 - protein, 392 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 314 - protein, 97 aa, Homo sapiens
MDKQSSAGGVKRSVPCESNEVNETMPETPTGDSDPQPAPKKMKTSESSTILVVRYRRNVKRTSPEELLNDHARENRINPLQMEEEEFMEIMVEIPAK

SEQ ID NO: 315 - protein, 971 aa, Homo sapiens
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLDEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 316 - protein, 837 aa, Homo sapiens
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTQPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 317 - protein, 303 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 318 - protein, 284 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRARQLEEELRTMDQALKSLMASEEEYSTKEDKYEEEIKLLEEKLKEAETRAEFAERSVAKLEKTIDDLEETLASAKEENVEIHQTLDQTLLELNNL

SEQ ID NO: 319 - protein, 173 aa, Homo sapiens [sequence omitted]

SEQ ID NO: 320 - protein, 185 aa, Homo sapiens
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQSGMLEAGVDRIISQVVDPKLNHIFRPQIERAIHEFLAAQKKAAVPAPPPEPEGQDPPAPSQDTS

SEQ ID NO: 321 - protein, 568 aa, Homo sapiens
MGLLTFRDVAIEFSLEEWQCLDTAQRNLYKNVILENYRNLVFLGIAVSKQDLITCLEQEKEPLTVKRHEMVNEPPVMCSHFAQEFWPEQNIKDSFEKVTLRRYEKCGNDNFQLKGCKSVDECKLHKGGYNGLNQCLPTMQSKMFQCDKYVKVFNKFSHSDRHKIKHMENKPFKCKECGRSFCMLSHLTRHERNYTKVNFCKCEECEKAVNQSSKLTKHKRIYTCEKLYKCQECDRTFNQFSNLTEYKKDYAREKPYKCEECGKAFNQSSHLTTHKIIHTGEKPYKCEECGKAFNQFSNLTTHKKIHTGEQPYICEECGKAFTQSSTLTTHKRIHTGEKPYKCEECGKAFNRSSKLTEHKNIHTGEQPYKCEECGKAFNRSSNLTEHRKIHTEEKPYKCKECGKAFKHSSALTTHKRIHTGEKPYKCEECGKAFNRSSKLTEHKKLHTGKKPYKCEECGKAFIQSSKLTEHKKIHSGEIPYKCEECGKAFKHSSSLTTHKRIHTGEKPYKCEECGKAFSRSSKLTEHKIIHTGEKPYKCERCDKAFNQSANLTKHKKIHTGEKLQNWNV

SEQ ID NO: 322 - protein, 320 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 323 - protein, 882 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 324 - protein, 2055 aa, Homo sapiens
QELTRLACSELRLLCPGPGFSELSYIKYTEMKRKVVNTHKLRLSPNEEAFILKEDYERRRKLRLLQVREQERDIALQIREDIKQRRNQQFTRLAEELRAEWEESQTQKIQNLEKLYLASLRSMGEGHRQAKENEPDLDALAQRAAERKRKADLRHKEALKVQKNQKEILLKQKTWHIKARKEALLVEKERSAKITSLPPPPPTLFENIEVKRISAVKTNSSTYHHLHTFVNRETDTKRPDARLAAEEEAKRLEELQKQAAQERMERFEKAHVRGFQAMKKIHLAQNQEKLMKELKQLQQEDLARRRQTVAQMPPQLVELPYKRSEMKEDWQRELEFAFEDMYNADRKVKGNLILHLEPEPLPTVTNQIQDEELDLSMEQENLGAAEDLPVTEAEICSSETDVPLVMKTQQIPSKVLFKKLLNKIRSQKSLWTIKSMSEDESEMITTVSEIESKAPTVESGTIASKERTLSSGQEQVVESDTLTIESGPLASEDKPLSCGTNSGKEQEINETLPITTVAQSSVLLHPQEAAARIRMSARQKQIMEIEEQKQKQLELLEQIEQQKLRLETDCFRAQLEEEKRKKTQPTGVGIAPASCPVISDEDSHRQMIRNYQHQLLQQNRLHRQSVETARKQLLEYQTMLKGRCPSVSAPSLITDSVISVPSWKSERPTAISEHWDQGQRLKLSPNKYQPIQPIQTSKLEQDHFQVARQNHFPQRQVETTETLRASDILTNQALESQEHLRQFSQTETQQRDYKLVPKDSETLSRALSHDRQLISQDARKISETFGATTFQSLESQQLFSENSENISYHLTEPSSFVPLVPQHSFSSLPVKVESGKIQEPFSAMSKSTVSTSHSIISQMHDRPLLPSENITAQQGNMKALQEQLDLQKKVLQATQEAQEQLLLCKQKEVEQQTGLSVFLPLVTPDSSALLPSAKADLGRIQESSPTKNNIAVSSDHHVISQLQDKRLSLSQPILSQQNNFKFLQEQLNIQKDSLQARREAQEVLYVHKQSELDRRVCSEQAEPSFPFQVAQHTFTSLPSADTKSGKIQEQHSSKSEKGLVSCQSDIPISQDGSLSFLQQFLPLHDSLKLLQEQLTKQRDTLQARHEAQVELLLHRQRDLGDSKSGLVSSSSSPVVVQHSVASQASAKAEPRRIQELYLSEKENVGPSCHLIIPTFQDKSLSFPQHSLAQQENLTILQEQSQIQRVILGAKEGTQEFVHTESELEKRISSEQTGTSSSLSQVDESERFQECISIKSDSTIPLSHPKIPRCQERLLRVSQHMLPLQDNLEEHQAWLDTEKEAFHFSQKTQENTSSEQTGSSSFIPQLVQLSFTSLASAESGTILEPLFTESESKIFSSHLQIPQLQDRLLRISQLIQPQQDNLKALQEQLATQREAIILARQEAREELLLHQSEWEGRISPEQVDTSSLPLVPQHSFASLPLNESERNQEPCSINSDNIVSSGHSEIPTLPDGLLGLSHLVLPQQDNLIALEEHLHAQTDFLPSIEKTQKELVLSKPCKFEEKVSSEHFIQSHHGDLQALQQQLDTQKKAIRSIQEVQEELLLQRLSELEKRVSSEQVCSSSFVSQVPVADSERTQKSFPTKSNDTLPSSHREIPRLQDRLLSLSKPILPQQDNMTAQLDAQREVMYSYEKPQEELSLNKQRKLNKSESAEHTIPSLFLPKETEHSFIPLPFAEAKPKSTCELYSSQNEHAAPPSNPVIPGFQDRLLSFSQSVLTQQDNLGLQKQLDLQREVLHYSQKAQEKLLVQRQTALQQQIQKHEETLKDFFKDSQISKPTVENDLKTQKMGQLRDWFPNTQDLAGNDQENIRHADRNNSDDNHLASEDTSAKQSGEHLEKDLGRRSSKPPVAKVKCGLDLNQHELSAIQEVESPAIGRTSILGKPGIYEDRDPLRVSISREQSFFGSPLAHDPFSCLQLVGQENVCGDDYDEAVKLKESVVENHAVLSYAVEEEHAYLGPTVKPDDKAKTLSYEPLSSATVSTGSLLSYENTDLSLTDPESFSEHMDDSKQESTTSKEEETNIISSIVPSTQDSAAELFRRS

SEQ ID NO: 325 - protein, 619 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 326 - protein, 255 aa, Homo sapiens
MWQGCAVERPVGRMTSQTPLPQSPRPRRPTMSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 327 - protein, 344 aa, Homo sapiens
MSGEPELIELRELAPAGRAGKGRTRLERANALRIARGTACNPTRQLVPGRGHRFQPAGPATHTWCDLCGDFIWGVVRKGLQCARLSADCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 328 - protein, 567 aa, Homo sapiens
MKPVWVATLLWMLLLVPRLGAARKGSPEEASFYYGTFPLGFSWGVGSSAYQTEGAWDQDGKGPSIWDVFTHSGKGKVLGNETADVACDGYYKVQEDIILLRELHVNHYRFSLSWPRLLPTGIRAEQVNKKGIEFYSDLIDALLSSNITPIVTLHHWDLPQLLQVKYGGWQNVSMANYFRDYANLCFEAFGDRVKHWITFSDPRAMAEKGYETGHHAPGLKLRGTGLYKAAHHIIKAHAKAWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 329 - protein, 393 aa, Homo sapiens
MSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRMEPPDGPPPPPQQQPPPPPQPPQPAPQATSCSFAQNIKEESSYCLYDSADKCPKVSATAAELAPFPRGPPPDGCALGTSSGVPVPGYFRLSQAYGTAKGYGSGGGGAQQLGAGPFPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 330 - protein, 104 aa, Homo sapiens
MQKPPAPHRGPLSLHLALTRTVIELALGAWGEWRGLGGIHWPQPQSFSSVTQEAKAQLEISPGHCICAKTYSCPCRACISCSPGYHNGVPFGGDVRPAACLGRS

SEQ ID NO: 331 - protein, 1410 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 332 - protein, 481 aa, Homo sapiens
MAAAPGGSAQPAGPGPRLGFSTADSGVGMSGLNPGPAVPMKDHDAIKLFVGQIPRGLDEQDLKPLFEEFGRIYELTVLKDRLTGLHKGCAFLTYCARDSALKAQSALHEQKTLPGMNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 333 - protein, 1124 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 334 - protein, 1416 aa, Homo sapiens
MKSLKSRLRRQDVPGPASSGAAAASAHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 335 - protein, 260 aa, Homo sapiens
MEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHIFSSLRIAATRSAAQTQGEDLARVHQGWLQYVQQDSCPQEGPQAR

SEQ ID NO: 336 - protein, 530 aa, Homo sapiens
MARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIACHYLEEGAQCPAPLSYVPRILLGFSDAMTFKERVRNHIMHLEEHLFCQYFSKNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 337 - protein, 153 aa, Homo sapiens
MMILVFWSNYPYEPVCLASHRNNMEASVPKYKKHLPQLGMQKEMEQDVKRFGQAAWATAIPRLEKLKLMLAQETLQLMRAKELCLNHKRAEIQGKMEDLPEQEKNINVVDELAIQFYEIQLELYEVKFEILKNKEILLTTQLDSLERLIKDEI

SEQ ID NO: 338 - protein, 629 aa, Homo sapiens
  misc_feature (174)..(174): Xaa can be any naturally occurring amino acid
  misc_feature (247)..(247): Xaa can be any naturally occurring amino acid
  misc_feature (498)..(498): Xaa can be any naturally occurring amino acid
  misc_feature (511)..(511): Xaa can be any naturally occurring amino acid
  misc_feature (558)..(558): Xaa can be any naturally occurring amino acid
  misc_feature (569)..(569): Xaa can be any naturally occurring amino acid
  misc_feature (592)..(592): Xaa can be any naturally occurring amino acid
  misc_feature (598)..(598): Xaa can be any naturally occurring amino acid
  misc_feature (601)..(601): Xaa can be any naturally occurring amino acid
  misc_feature (612)..(612): Xaa can be any naturally occurring amino acid
MHGAAYSVQHSVGWPGGMEQPACPRKAGVTGHNWTQAVRRGQARARQALGPLPPTAMEDEQPDSLEGWAPLREGLFADPQRHRLRFLVAWNGAEGKFAVTCHDRTAQQPQRREGARLGLEHKPEAAVSPPSWAGRLSAAGFRGARRQPAALWPPLEHCFPRLPPELDVGGGGAXGLGLGRWALLWPARVGPGEAALQELCGQLERYLGAAAHGCGGATVRDALFAAKGRAADCESPREFRERALRAXWVEADARLRQVIQGHGKANTMVALMKVYQEEDEAYQELVTVATTFFQYLLRPFRAMREVATLCKLDILKSLDEDDLGPRRVVALEKEAEEWTRRAGEAVVSIQDITVNYFKETVKALAGMQKEMEQDVKRLGQAAWATAIPRLEKLKLMLAQETLQLMRAKELYLNCKRAEIQGKMEDLPEQEKNINVVDELEIQFYEIQLELYEVKFEILKNKEILLTTQLDSLERLIKEKQDEVVYYDPCESPEELSHXLWWGCRTIRIRKXKNSEGSASSWSLLNGAGSVSKELLSRVERISAKKIIGSDCNRLKKAXDILVSITVFRXDKIKRSKRKKNGSTKNVKHSNDXEHLKMXVLXTITSSTLLGKXMKTALKRKVLRTGHSEH

SEQ ID NO: 339 - protein, 544 aa, Homo sapiens
MEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 340 - protein, 898 aa, Homo sapiens
MSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKKLIKENKKHQELFVDICSEKDNLREELKKRTETEKQHMNTIKQLESRIEELNKEVKASRDQLIAQDVTAKNAVQQLHKEMAQRMEQANKKCEEARQEKEAMVMKYVRGEKESLDLRKEKETLEKKLRDANKELEKNTNKIKQLSQEKGRLHQLYETKEGETTRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLQKAHARKNEKIEFMEDHIKQLVEEIRKKTKIIQSYILREESGTLSSEASDFNKVHLSRRGGIMASLYTSHPADNGLTLELSLEINRKLQAVLEDTLLKNITLKENLQTLGTEIERLIKHQHELEQRTKKT

SEQ ID NO: 341 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEAITLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 342 - protein, 1212 aa, Homo sapiens
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 343 - protein, 1211 aa, Homo sapiens
MLSLAAKLVAFFWRTADTPREEAGQLEPELAEGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 344 - protein, 1194 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 345 - protein, 131 aa, Homo sapiens
MEMGKWIHLELRNRTPSDVKELFLDNSQSNEGKLEGLTDEFEELELLNTINIGLTSIANLPKLNKLKKLELSSNRASVGLEVLAEKCPNLIHLNLSGNKIKDLSTIEPLKKLENLESLDLFTCEVTNLNNY

SEQ ID NO: 346 - protein, 441 aa, Homo sapiens
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTIHQACKLICRKCKRHVTDLTGQVVQEGTRRYRLCNECLAEFGIDSLPIDLEAEQHLMSPSDGDKDSRWHLSEDENRSYVEIVEDGSGDLVIQQVDDSEEEEEKEIKPNIR

SEQ ID NO: 347 - protein, 147 aa, Homo sapiens
MTSQPISNETIIMLPSNVINFSQAEKPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 348 - protein, 549 aa, Homo sapiens
PLTLADFEAINRCNRPLPKNFNFAADVLDQWSQKEKTGERPANPALWWVNGKGDEVKWSFRELGSLSRKAANVLTKPCGLQRGDRLAVILPRIPEWWLVNVACIRTGIIFMPGTIQLTAKDILYRLRASKAKCIVASEEVAPAVESIVLECPDLKTKLLVSPQSWNGWLSFQELFQFASEEHSCVETGSQEPMTIYFTSGTTGFPKMAQHSQSSLGIGFTLCGRYWLDLKSSDIIWNMSDTGWVKAAIGSVFSSWLCGACVFVHRMAQFDTDTFLDTLTTYPITTLCSPPTVYRMLVQKDLKRYKFKSLRHCLTGGEPLNPEVLEQWRVQTGLELYEGYGQTEVGMICANQKGQEIKPGSMGKGMLPYDVQIIDENGNVLPPGKEGEIALRLKPTRPFCFFSNYLDNPQKTAATIRGDFYVTGDRGVMDSDGYFWFVGRADDVIISSGYRIGPFEVESALIEHPAVVESAVVSSPDQIRGEVVKAFVVLAAPFKSYNPEKLTLELQDHVKKSTAPYKYPRKVEFVQELPKTITGKIKRNVLRDQEWRGR

SEQ ID NO: 349 - protein, 436 aa, Homo sapiens
MSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPESPPYSSGSYDSIKTEVSGCPEDLTVGRAPTADDDDDDHDDHEDNDKMNDSEGMDPERLKAFNMFVRLFVDENLDRMVPISKQPKEKIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTSTTPTPTPSSTSTSRPVPTAQLSPTEISAVRQLIAGYRESAAFLLRSADELENLILQQN

SEQ ID NO: 350 - protein, 239 aa, Homo sapiens
MECLCSDGFAFPHYYIKPYHLKRIHRAVLRGNLEKLKYLLLTYYDANKRDRKERTALHLACATGQPEMVHLLVSRRCELNLCDREDRTPLIKAVQLRQEACATLLLQNGADPNITDFFGRTALHYAVYNEDTSMIEKLLSHGTNIEECSKNEYQPLLLAVSRRKVKMVEFLLKKKANVNAIDYLGRSALILAVTLGEKDIVILLLQHNIDVFSRDVYGKLAEDYASEAENRVVSSETTS

SEQ ID NO: 351 - protein, 263 aa, Homo sapiens
MGQTALAGGSSSTPTPQALYPDLSCPEGLEELLSAPPPDLGAQRRHGWNPKDCSENIEVKEGGLYFERRPVAQSTDGARGKRGYSRGLHAWEISWPLEQRGTHAVVGVATALAPLQTDHYAALLGSNSESWGWDIGRGKLYHQSKGPGAPQYPAGTQGEQLEVPERLLVVLDMEEGTLGYAIGGTYLGPAFRGLKGRTLYPAVSAVWGQCQVRIRYLGERRAEPHSLLHLSRLCVRHNLGDTRLGQVSALPLPPAMKRYLLYQ

SEQ ID NO: 352 - protein, 715 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 353 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 354 - protein, 162 aa, Homo sapiens
MALARPRPRLGDLIEISRFGYAHWAIYVGDGYVVHLAPASEIAGAGAASVLSALTNKAIVKKELLSVVAGGDNYRVNNKHDDRYTPLPSNKIVKRAEELVGQELPYSLTSDNCEHFVNHLRYGVSRSDQVTGAVTTVGVAAGLLAAASLVGILLARSKRERQ

SEQ ID NO: 355 - protein, 257 aa, Homo sapiens
MGTVRPPRPSLLLVSTRESCLFLLFCLHLGAACPQPCRCPDHAGAVAVFCSLRGLQEVPEDIPANTVLLKLDANKISHLPDGAFQHLHRLRELDLSHNAIEAIGSATFAGLAGGLRLLDLSYNRIQRIPKDALGKLSAKIRLSHNPLHCECALQEALWELKLDPDSVDEIACHTSVQEEFVGKPLVQALDAGASLCSVPHRTTDVAMLVTMFGWFAMVIAYVVYYVRHNQEDARRHLEYLKSLPSAPASKDPIGPGP

SEQ ID NO: 356 - protein, 1140 aa, Homo sapiens
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQIELREREIERLSVALDGGRSPDVLSLESRNKTNEKLIAHLNIQVDFLQQANKDLEKRIRELMETKETVTSEVVNLSNKNEKLCQELTEIDQLAQQLERHKEEVLETADKELGEAKKEIKRKLSEMQDLEETMAKLQLELNLCQKEKERLSDELLVKSDLETVVHQLEQEKQRLSKKVESFAVTERQLTLEVERMRLEHGIKRRDRSPSRLDTFLKGIEEERDYYKKELERLQHIIQRRSCSTSYSAREKSSIFRTPEKGDYNSEIHQITRERDELQRMLERFEKYMEDIQSNVKLLTAERDKLSVLYNEAQEELSALRKESTQTTAPHNIVSLMEKEKELALSDLRRIMAEKEALREKLEHIEEVSLFGKSELEKTIEHLTCVNHQLESEKYELKSKVLIMKETIESLENKLKVQAQKFSHVAGDSSHQKTEVNSLRIVNEQLQRSVDDYQHRLSIKRGELESAQAQIKILEEKIDELNLKMTSQDEEAHVMKKTIGVIDKEKDFLQETVDEKTEKIANLQENLANKEKAVAQMKIMISECESSVNQLKETLVNRDREINSLRRQLDAAHKELDEVGRSREIAFKENRRLQDDLATMARENQEISLELEAAVQEKEEMKSRVHKYITEVSRWESLMAAKEKENQDLLDRFQMLHNRAEDWEVKAHQAEGESSSVRLELLSIDTERRHLRERVELLEKEIQEHINAHHAYESQISSMAKAMSRLEEELRHQEDEKATVLNDLSSLRELCIKLDSGKDIMTQQLNSKNLEFERVVVELENVKSESDLLKKQLSNERHTVKNLESLLATNRDKEFHSHLTSHEKDTEIQLLKEKLTLSESKLTSQSRENTMLRAKVAQLQTDYDALKRQISTERYERERAIQEMRRHGLATPPLSSTLRSPSHSPEHRNV

SEQ ID NO: 357 - protein, 273 aa, Homo sapiens
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 358 - protein, 1165 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVGKCQKCTETHGVYPELANLSSDMGFSFFF

SEQ ID NO: 359 - protein, 394 aa, Homo sapiens
MALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQVYFGTSHPRYYISANVTGFKCVTGMSCLMRKDVLDQAGGLIAFAQYIAEDYFMAKAIADRGWRFAMSTQVAMQNSGSYSISQFQSRMIRWTKLRINMLPATIICEPISECFVASLIIGWAAHHVFRWDIMVFFMCHCLAWFIFDYIQLRGVQGGTLCFSKLDYAVAWFIRESMTIYIFLSALWDPTISWRTGRYRLRCGGTAEEILDV

SEQ ID NO: 360 - protein, 494 aa, Homo sapiens
MLASGLLLVTLLACLTVMVLMSVWRQRKSRGKLPPGPTPLPFIGNYLQLNTEQMYNSLMKISERYGPVFTIHLGPRRVVVLCGHDAVKEALVDQAEEFSGRGEQATFDWLFKGYGVAFSNGERAKQLRRFSIATLRGFGVGKRGIEERIQEEAGFLIDALRGTHGANIDPTFFLSRTVSNVISSIVFGDRFDYEDKEFLSLLRMMLGSFQFTATSTGQLYEMFSSVMKHLPGPQQQAFKELQGLEDFIAKKVEHNQRTLDPNSPRDFIDSFLIRMQEEEKNPNTEFYLKNLVMTTLNLFFAGTETVSTTLRYGFLLLMKHPEVEAKVHEEIDRVIGKNRQPKFEDRAKMPYTEAVIHEIQRFGDMLPMGLAHRVNKDTKFRDFFLPKGTEVFPMLGSVLRDPRFFSNPRDFNPQHFLDKKGQFKKSDAFVPFSIGKRYCFGEGLARMELFLFFTTIMQNFRFKSPQSPKDIDVSPKHVGFATIPRNYTMSFLPR

SEQ ID NO: 361 - protein, 592 aa, Homo sapiens
AAAAGAGNRAAVAVAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 362 - protein, 954 aa, Homo sapiens
MEAGGLPLELWRMILAYLHLPDLGRCSLVCRAWYELILSLDSTRWRQLCLGCTECRHPNWPNQPDVEPESWREAFKQHYLASKTWTKNALDLESSICFSLFRRRRERRTLSVGPGREFDSLGSALAMASLYDRIVLFPGVYEEQGEIILKVPVEIVGQGKLGEVALLASIDQHCSTTRLCNLVFTPAWFSPIMYKTTSGHVQFDNCNFENGHIQVHGPGTCQVKFCTFKNTHIFLHNVPLCVLENCEFVGSENNSVTVEGHPSADKNWAYKYLLGLIKSSPTFLPTEDSDFLMSLDLESRDQAWSPKTCDIVIEGSQSPTSPASSSPKPGSKAGSQEAEVGSDGERVAQTPDSSDGGLSPSGEDEDEDQLMYRLSYQVQGPRPVLGGSFLGPPLPGASIQLPSCLVLNSLQQELQKDKEAMALANSVQGCLIRKCLFRDGKGGVFVCSHGRAKMEGNIFRNLTYAVRCIHNSKIIMLRNDIYRCRASGIFLRLEGGGLIAGNNIYHNAEAGVDIRKKSNPLCNQIHHGLRSGIVVLGNGKGIIRNNQIFSNKEAGIYILYHGNPVVSGNHIFKGRAAGIAVNENGKGLITENVIRENQWGGVDIRRGGIPVLRSNLICFGYSDGVVVGDEGKGLIEGNTIYANKGCGVWMMSSSLPHVTSNHVSYNGLYGVAVFSQKDGSSELPRGHRAQENFSEDGDAILWETELEKEDDPLRRPITIALVESNSINHNGASGLYVQSSEALHVITNVIHANGDRGITVAQSSQPTRVANNSISCNRQSGVKVEAQCKVELRGNGIYDNRGHGIITKGDSTIVIENDIIGNRGSGLQLLPRSDTKVIKNRIHSFRAYGIAVRGRAKALVQENIIFQGKTSKTIFQQISNNRECIMQNNKFLVFKKKSDTWRLVNPPARPHLENSLRRPSAAHNGQKVTAMATRITARVEGGYHSNRSVFCTIL

SEQ ID NO: 363 - protein, 301 aa, Homo sapiens
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 364 - protein, 131 aa, Homo sapiens
MDFQQLADVAEKWCSNTPFELIATEETERRMDFYADPGVSFYVLCPDNGCGDNFHVWSESEDCLPFLQLAQDYISSCGKKTLHEVLEKVFKSFRPLLGLPDADDDAFEEYSADVEEEEPEADHPQMGVSQQ

SEQ ID NO: 365 - protein, 170 aa, Homo sapiens
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 366 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 367 - protein, 176 aa, Homo sapiens
MAMSFEWPWQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 368 - protein, 167 aa, Homo sapiens
MASPRTVTIVALSVALGLFFVFMGTIKLTPRLSKDAYSEMKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSEKKPLPGNAEEQPSLYEKAPQGKVKVS

SEQ ID NO: 369 - protein, 123 aa, Homo sapiens
MSTLSNFTQTLEDVFRRIFITYMDNWRQNTTAEQEALQAKVDAENFYYVILYLMVMIGMFSFIIVAILVSTVKSKRREHSNDPYHQYIVEDWQEKYKSQILNLEESKATIHENIGAAGFKMSP

SEQ ID NO: 370 - protein, 712 aa, Homo sapiens
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVLQQLLNHCRKNRDKVLLFSFSTKLLDVLQQYCMASGLDYRRLDGSTKSEERLKIVKEFNSTQDVNICLVSTMAGGLGLNFVGANVVVLFDPTWNPANDLQAIDRAYRIGQCRDVKVLRLISLGTVEEIMYLRQIYKQQLHCVVVGSENAKRYFEAVQGSKEHQGELFGIHNLFKFRSQGSCLTKDILEV

SEQ ID NO: 371 - protein, 356 aa, Homo sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 372 - protein, 178 aa, Homo sapiens
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKAMARDEKNYYQDTPKQIRSKINVYKRFYPAEWQDFLDSLQKRKMEVE

SEQ ID NO: 373 - protein, 664 aa, Homo sapiens
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHCIGYPVVTLGFGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 374 - protein, 393 aa, Homo sapiens
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNDDENF

SEQ ID NO: 375 - protein, 591 aa, Homo sapiens
MWERLNCAAEDFYSRLLQKFNEEKKGIRKDPFLYEADVQVQLISKGQPNPLKNILNENDIVFIVEKVPLEKEETSHIEELQSEETAISDFSTGENVGPLALPVGKARQLIGLYTMAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 376 - protein, 514 aa, Homo sapiens
MYSQRFGTVQREVKGPTPKVVIVRSKPPKGQGAEHHLERIRRSHQKHNAILASIKSSERDRLKAEWDQHNDCKILDSLVRARIKDAVQGFIINIEERRNKLRELLALEENEYFTEMQLKKETIEEKKDRMREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVESNNAQIKHENEQDMLKKQKAKQETRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFARRQRLAQEYRKQLQMQIAYQQQSQEAEKEEKRREFEAGVAANKMCLDKVQEVLSTHQVLPQNIHPMRKACPSKLPP

SEQ ID NO: 377 - protein, 432 aa, Homo sapiens
MPAGRAARTCALLALCLLGAGAQDFGPTRFICTSVPVDADMCAASVAAGGAEELRSSVLQLRETVLQQKETILSQKETIRELTAKLGRCESQSTLDPGAGEARAGGGRKQPGSGKNTMGDLSRTPAAETLSQLGQTLQSLKTRLENLEQYSRLNSSSQTNSLKDLLQSKIDELERQVLSRVNTLEEGKGGPRNDTEERVKIETALTSLHQRISELEKGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 378 - protein, 585 aa, Homo sapiens
MGSLKEELLKAIWHAFTALDQDHSGKVSKSQLKVLSHNLCTVLKVPHDPVALEEHFRDDDEGPVSNQGYMPYLNRFILEKVQDNFDKIEFNRMCWTLCVKKNLTKNPLLITEEDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEQLELERKQALEQYEEVKKKLEMATNKTKSWKDKVAHHEGLIRLIEPGSKNPHLITNWGPAAFTEAELEEREKNWKEKKTTE

SEQ ID NO: 379 - protein, 1164 aa, Homo sapiens
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 380 - protein, 480 aa, Homo sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

What is claimed:

1. A method of evaluating the competence of a mammalian oocyte for implantation comprising:
   (i) determining in a sample the level of marker expression of at least one nucleic acid selected from the group of nucleic acids exemplified by SEQ ID NOS: 19, 25, 33, 38, and 43, and
   (ii) comparing the level of marker expression in the sample with a control or reference standard, wherein detecting differential marker expression between the sample and the control is indicative of the competence of the oocyte for implantation.

2. The method of claim 1, wherein the sample is derived from an oocyte.

3. The method of claim 2, wherein the control or reference standard is derived from one of the group consisting of: an oocyte competent for implantation, a chromosomally normal oocyte, an oocyte not competent for implantation, and a chromosomally abnormal oocyte.

4. The method of claim 1, wherein the sample is derived from follicular fluid.

5. The method of claim 4, wherein the control or reference standard is derived from one of the group consisting of: follicular fluid associated with an oocyte competent for implantation, follicular fluid associated with a chromosomally normal oocyte, follicular fluid associated with an oocyte not competent for implantation and follicular fluid associated with a chromosomally abnormal oocyte.

6. The method of claim 1, wherein the sample is derived from culture medium.

7. The method of claim 6, wherein the control or reference standard is derived from one of the group consisting of: culture medium associated with an oocyte competent for implantation, culture medium associated with a chromosomally normal oocyte, culture medium associated with an oocyte not competent for implantation, and culture medium associated with a chromosomally abnormal oocyte.

8. The method of claim 1, wherein the level of marker expression determined in the sample is at least 20% different from the level of marker expression determined in the control or reference standard.

9. The method of claim 1, wherein the level of marker expression is detected by at least one of the group consisting of nucleic acid microarray, Northern blot, and reverse transcription PCR.

10. The method of claim 1, wherein the level of marker expression is detected by at least one of the group consisting of Western blot, enzyme-linked immunosorbent assay, protein microarray and FACS analysis.

11. The method of claim 1, wherein the mammalian oocyte is of a domesticated mammal.

12. The method of claim 1, wherein the mammalian oocyte is of a human.

13. A method of evaluating the competence of a mammalian oocyte for implantation comprising:
   (i) determining in a sample the level of marker expression of at least one nucleic acid selected from the group of nucleic acids exemplified by SEQ ID NOS: 184, 187, 189, 191, and 230, and
   (ii) comparing the level of marker expression in the sample with a control or reference standard, wherein detecting differential marker expression between the sample and the control is indicative of the competence of an oocyte for implantation.

14. The method of claim 13, wherein the sample is derived from a cumulus cell.

15. The method of claim 14, wherein the control or reference standard is derived from one of the group consisting of a cumulus cell associated with an oocyte competent for implantation, a cumulus cell associated with a chromosomally normal oocyte, a cumulus cell associated with an oocyte not competent for implantation and a cumulus cell associated with a chromosomally abnormal oocyte.

16. The method of claim 13, wherein the sample is derived from follicular fluid.

17. The method of claim 16, wherein the control or reference standard is derived from one of the group consisting of: follicular fluid associated with a cumulus cell associated with an oocyte competent for implantation, follicular fluid associated with a cumulus cell associated with a chromosomally normal oocyte, follicular fluid associated with a cumulus cell associated with an oocyte not competent for implantation and follicular fluid associated with a cumulus cell associated with a chromosomally abnormal oocyte.

18. The method of claim 13, wherein the sample is derived from culture medium.

19. The method of claim 18, wherein the control or reference standard is derived from one of the group consisting of: culture medium associated with a cumulus cell associated with an oocyte competent for implantation, culture medium associated with a cumulus cell associated with a chromosomally normal oocyte, culture medium associated with a cumulus cell associated with an oocyte not competent for implantation, and culture medium associated with a cumulus cell associated with a chromosomally abnormal oocyte.

20. The method of claim 13, wherein the level of marker expression determined in the sample is at least 20% different from the level of marker expression determined in the control or reference standard.

21. The method of claim 13, wherein the level of marker expression is detected by at least one of the group consisting of nucleic acid microarray, Northern blot, and reverse transcription PCR.

22. The method of claim 13, wherein the level of marker expression is detected by at least one of the group consisting of Western blot, enzyme-linked immunosorbent assay, protein microarray and FACS analysis.

23. The method of claim 13, wherein the mammalian oocyte is of a domesticated mammal.

24. The method of claim 13, wherein the mammalian oocyte is of a human.

25. A method of evaluating the competence of a mammalian oocyte for fertilization comprising:
   (i) determining in a sample the level of marker expression of at least one nucleic acid selected from the group of nucleic acids exemplified by SEQ ID NOS: 19, 25, 33, 38, and 43 and
   (ii) comparing the level of marker expression in the sample with a control or reference standard, wherein detecting differential marker expression between the sample and the control is indicative of the competence of the oocyte for implantation.

26. The method of claim 25, wherein the sample is derived from an oocyte.

27. The method of claim 26, wherein the control or reference standard is derived from one of the group consisting of: an oocyte competent for fertilization, a chromosomally normal oocyte, an oocyte not competent for fertilization, and a chromosomally abnormal oocyte.

28. The method of claim 25, wherein the sample is derived from follicular fluid.

29. The method of claim 28, wherein the control or reference standard is derived from one of the group consisting of: follicular fluid associated with an oocyte competent for fertilization, follicular fluid associated with a chromosomally normal oocyte, follicular fluid associated with an oocyte not competent for fertilization, and follicular fluid associated with a chromosomally abnormal oocyte.

30. The method of claim 25, wherein the sample is derived from culture medium.

31. The method of claim 30, wherein the control or reference standard is derived from one of the group consisting of: culture medium associated with an oocyte competent for fertilization, culture medium associated with a chromosomally normal oocyte, culture medium associated with an oocyte not competent for fertilization, and culture medium associated with a chromosomally abnormal oocyte.

32. The method of claim 25, wherein the level of marker expression determined in the sample is at least 20% different from the level of marker expression determined in the control or reference standard.

33. The method of claim 25, wherein the level of marker expression is detected by at least one of the group consisting of nucleic acid microarray, Northern blot, and reverse transcription PCR.

34. The method of claim 25, wherein the level of marker expression is detected by at least one of the group consisting of Western blot, enzyme-linked immunosorbent assay, protein microarray and FACS analysis.

35. The method of claim 25, wherein the mammalian oocyte is of a domesticated mammal.

36. The method of claim 25, wherein the mammalian oocyte is of a human.

37. A method of evaluating the competence of a mammalian oocyte for fertilization comprising:
  (i) determining in a sample the level of marker expression of at least one nucleic acid selected from the group of nucleic acids exemplified by SEQ ID NOS: 184, 187, 189, 191, and 230, and
  (ii) comparing the level of marker expression in the sample with a control or reference standard, wherein detecting differential marker expression between the sample and the control is indicative of the competence of an oocyte for fertilization.

38. The method of claim 37, wherein the sample is derived from a cumulus cell.

39. The method of claim 38, wherein the control or reference standard is derived from one of the group consisting of: a cumulus cell associated with an oocyte competent for fertilization, a cumulus cell associated with a chromosomally normal oocyte, a cumulus cell associated with an oocyte not competent for fertilization, and a cumulus cell associated with a chromosomally abnormal oocyte.

40. The method of claim 37, wherein the sample is derived from follicular fluid.

41. The method of claim 40, wherein the control or reference standard is derived from one of the group consisting of: follicular fluid associated with a cumulus cell associated with an oocyte competent for fertilization, follicular fluid associated with a cumulus cell associated with a chromosomally normal oocyte, follicular fluid associated with a cumulus cell associated with an oocyte not competent for fertilization, and follicular fluid associated with a cumulus cell associated with a chromosomally abnormal oocyte.

42. The method of claim 37, wherein the sample is derived from culture medium.

43. The method of claim 42, wherein the control or reference standard is derived from one of the group consisting of: culture medium associated with a cumulus cell associated with an oocyte competent for fertilization, culture medium associated with a cumulus cell associated with a chromosomally normal oocyte, culture medium associated with a cumulus cell associated with an oocyte not competent for fertilization and culture medium associated with a cumulus cell associated with a chromosomally abnormal oocyte.

44. The method of claim 37, wherein the level of marker expression determined in the sample is at least 20% different from the level of marker expression determined in the control or reference standard.

45. The method of claim 37, wherein the level of marker expression is detected by at least one of the group consisting of nucleic acid microarray, Northern blot, and reverse transcription PCR.

46. The method of claim 37, wherein the level of marker expression is detected by at least one of the group consisting of Western blot, enzyme-linked immunosorbent assay, protein microarray and FACS analysis.

47. The method of claim 37, wherein the mammalian oocyte is of a domesticated mammal.

48. The method of claim 37, wherein the mammalian oocyte is of a human.

* * * * *